US010905739B2

(12) United States Patent
Annis et al.

(10) Patent No.: US 10,905,739 B2
(45) Date of Patent: Feb. 2, 2021

(54) PEPTIDOMIMETIC MACROCYCLES AND FORMULATIONS THEREOF

(71) Applicant: AILERON THERAPEUTICS, INC., Cambridge, MA (US)

(72) Inventors: David Allen Annis, Cambridge, MA (US); Krzysztof Darlak, Newton, MA (US); Chris Rhodes, San Diego, CA (US); Sonoko Kanai, Basel (CH); Joerg Hoernschemeyer, Loerrach (DE); Michaela Grass, Rheinfelden (DE)

(73) Assignee: Aileron Therapeutics, Inc., Watertown, MA (US)

( * ) Notice: Subject to any disclaimer, the term of this patent is extended or adjusted under 35 U.S.C. 154(b) by 0 days.

(21) Appl. No.: 14/864,687

(22) Filed: Sep. 24, 2015

(65) Prior Publication Data

US 2016/0101145 A1  Apr. 14, 2016

Related U.S. Application Data

(60) Provisional application No. 62/054,842, filed on Sep. 24, 2014.

(51) Int. Cl.
| *A61K 38/12* | (2006.01) |
| *A61K 9/00* | (2006.01) |
| *A61K 38/10* | (2006.01) |
| *A61K 47/26* | (2006.01) |
| *A61P 35/00* | (2006.01) |

(52) U.S. Cl.
CPC ............ *A61K 38/12* (2013.01); *A61K 9/0019* (2013.01); *A61K 38/10* (2013.01); *A61K 47/26* (2013.01); *A61P 35/00* (2018.01)

(58) Field of Classification Search
None
See application file for complete search history.

(56) References Cited

U.S. PATENT DOCUMENTS

| 4,000,259 A | 12/1976 | Garsky |
| 4,191,754 A | 3/1980 | Nutt et al. |
| 4,270,537 A | 6/1981 | Romaine |
| 4,438,270 A | 3/1984 | Bey et al. |
| 4,596,556 A | 6/1986 | Morrow et al. |
| 4,683,195 A | 7/1987 | Mullis et al. |
| 4,683,202 A | 7/1987 | Mullis |
| 4,730,006 A | 3/1988 | Bohme et al. |
| 4,737,465 A | 4/1988 | Bond et al. |
| 4,790,824 A | 12/1988 | Morrow et al. |
| 4,886,499 A | 12/1989 | Cirelli et al. |
| 4,940,460 A | 7/1990 | Casey et al. |
| 4,941,880 A | 7/1990 | Burns |
| 5,015,235 A | 5/1991 | Crossman |
| 5,064,413 A | 11/1991 | McKinnon et al. |
| 5,094,951 A | 3/1992 | Rosenberg |
| 5,120,859 A | 6/1992 | Webb |
| 5,141,496 A | 8/1992 | Dalto et al. |
| 5,190,521 A | 3/1993 | Hubbard et al. |
| 5,245,009 A | 9/1993 | Kornreich et al. |
| 5,310,910 A | 5/1994 | Drtina et al. |
| 5,312,335 A | 5/1994 | McKinnon et al. |
| 5,323,907 A | 6/1994 | Kalvelage |
| 5,328,483 A | 7/1994 | Jacoby |
| 5,334,144 A | 8/1994 | Alchas et al. |
| 5,339,163 A | 8/1994 | Homma et al. |
| 5,364,851 A | 11/1994 | Joran |
| 5,383,851 A | 1/1995 | McKinnon, Jr. et al. |
| 5,384,309 A * | 1/1995 | Barker .................. C07K 14/78 |
| | | 514/13.6 |
| 5,417,662 A | 5/1995 | Hjertman et al. |
| 5,446,128 A | 8/1995 | Kahn |
| 5,466,220 A | 11/1995 | Brenneman |
| 5,480,381 A | 1/1996 | Weston |
| 5,503,627 A | 4/1996 | McKinnon et al. |
| 5,520,639 A | 5/1996 | Peterson et al. |
| 5,527,288 A | 6/1996 | Gross et al. |
| 5,569,189 A | 10/1996 | Parsons |
| 5,599,302 A | 2/1997 | Lilley et al. |
| 5,622,852 A | 4/1997 | Korsmeyer |
| 5,649,912 A | 7/1997 | Peterson |
| 5,650,133 A | 7/1997 | Carvalho et al. |

(Continued)

FOREIGN PATENT DOCUMENTS

| CA | 2761253 A1 | 6/2013 |
| CN | 1252808 A | 5/2000 |

(Continued)

OTHER PUBLICATIONS

Annis, et al. ALIS: An affinity selection-mass spectrometry system for the discovery and characterization of protein-ligand Interactions. Mass Spectrometry in Medicinal Chemistry: Applications in Drug Discovery (2007): 121-156.
Baek, et al. Structure of the stapled p53 peptide bound to Mdm2. J Am Chem Soc. Jan. 11, 2012;134(1):103-6. doi: 10.1021/ja2090367. Epub Dec. 14, 2011.
Bansal, et al. Salt selection in drug development. Pharmaceutical Technology. 2008, 3(32), 12 pages.
Berge et al. Pharmaceutical Salts. Journal of Pharmaceutical Sciences 66(1):1-19 (Jan. 1977).
Bernal, et al. Reactivation of the p53 tumor suppressor pathway by a stapled p53 peptide. J Am Chem Soc. Mar. 7, 2007;129(9):2456-7.
Brea, et al. Synthesis of omega-(hetero)arylalkynylated alpha-amino acid by Sonogashira-type reactions in aqueous media. J Org Chem. Sep. 29, 2006;71(20):7870-3.

(Continued)

*Primary Examiner* — Thomas S Heard
(74) *Attorney, Agent, or Firm* — Wilson Sonsini Goodrich & Rosati

(57) ABSTRACT

Aqueous pharmaceutical formulations, for parenteral administration, comprising peptidomimetic macrocycle or a pharmaceutically acceptable salt thereof wherein the peptidomimetic macrocycle binds to MDM2 and/or MDMX proteins are disclosed. Also disclosed are methods of treating diseases and disorders using the aqueous pharmaceutical formulations disclosed herein.

24 Claims, 4 Drawing Sheets

Specification includes a Sequence Listing.

(56) References Cited

U.S. PATENT DOCUMENTS

| | | |
|---|---|---|
| 5,663,316 A | 9/1997 | Xudong |
| 5,672,584 A | 9/1997 | Borchardt et al. |
| 5,702,908 A | 12/1997 | Picksley et al. |
| 5,704,911 A | 1/1998 | Parsons |
| 5,708,136 A | 1/1998 | Burrell et al. |
| 5,710,245 A | 1/1998 | Kahn |
| 5,731,408 A | 3/1998 | Hadley et al. |
| 5,750,767 A | 5/1998 | Carpino et al. |
| 5,756,669 A | 5/1998 | Bischoff et al. |
| 5,770,377 A | 6/1998 | Picksley et al. |
| 5,811,515 A | 9/1998 | Grubbs et al. |
| 5,817,752 A | 10/1998 | Yu |
| 5,817,789 A | 10/1998 | Heartlein et al. |
| 5,824,483 A | 10/1998 | Houston, Jr. et al. |
| 5,834,209 A | 11/1998 | Korsmeyer |
| 5,837,845 A | 11/1998 | Hosokawa et al. |
| 5,840,833 A | 11/1998 | Kahn |
| 5,856,445 A | 1/1999 | Korsmeyer |
| 5,859,184 A | 1/1999 | Kahn et al. |
| 5,874,529 A | 2/1999 | Gilon et al. |
| 5,893,397 A | 4/1999 | Peterson et al. |
| 5,922,863 A | 7/1999 | Grubbs et al. |
| 5,955,593 A | 9/1999 | Korsmeyer |
| 5,965,703 A | 10/1999 | Horne et al. |
| 5,993,412 A | 11/1999 | Deily et al. |
| 5,998,583 A | 12/1999 | Korsmeyer |
| 6,030,997 A | 2/2000 | Eilat et al. |
| 6,031,073 A | 2/2000 | Yu |
| 6,043,339 A | 3/2000 | Lin et al. |
| 6,046,289 A | 4/2000 | Komazawa et al. |
| 6,051,554 A | 4/2000 | Hornik et al. |
| 6,054,556 A | 4/2000 | Huby et al. |
| 6,118,010 A | 9/2000 | Ueda et al. |
| 6,153,391 A | 11/2000 | Picksley et al. |
| 6,169,073 B1 | 1/2001 | Halazonetis et al. |
| 6,177,076 B1 | 1/2001 | Lattime et al. |
| 6,177,542 B1 | 1/2001 | Ruoslahti et al. |
| 6,184,344 B1 | 2/2001 | Kent et al. |
| 6,204,361 B1 | 3/2001 | Carpino et al. |
| 6,245,886 B1 | 6/2001 | Halazonetis et al. |
| 6,271,198 B1 | 8/2001 | Braisted et al. |
| 6,287,787 B1 | 9/2001 | Houghten et al. |
| 6,326,354 B1 | 12/2001 | Gross et al. |
| 6,348,558 B1 | 2/2002 | Harris et al. |
| 6,420,118 B1 | 7/2002 | Halazonetis et al. |
| 6,420,136 B1 | 7/2002 | Riabowol et al. |
| 6,444,425 B1 | 9/2002 | Reed et al. |
| 6,495,674 B1 | 12/2002 | Lemke et al. |
| 6,514,685 B1 | 2/2003 | Moro |
| 6,569,993 B1 | 5/2003 | Sledeski et al. |
| 6,572,856 B1 | 6/2003 | Taylor et al. |
| 6,610,657 B1 | 8/2003 | Goueli |
| 6,613,874 B1 | 9/2003 | Mazur et al. |
| 6,686,148 B1 | 2/2004 | Shen et al. |
| 6,703,382 B2 | 3/2004 | Wang et al. |
| 6,713,280 B1 | 3/2004 | Huang et al. |
| 6,784,157 B2 | 8/2004 | Halazonetis et al. |
| 6,849,428 B1 | 2/2005 | Evans et al. |
| 6,875,594 B2 | 4/2005 | Muir et al. |
| 7,064,193 B1 | 6/2006 | Cory et al. |
| 7,083,983 B2 | 8/2006 | Lane et al. |
| 7,084,244 B2 | 8/2006 | Gilon et al. |
| 7,115,372 B2 | 10/2006 | Shen et al. |
| 7,183,059 B2 | 2/2007 | Verdine et al. |
| 7,189,801 B2 | 3/2007 | Halazonetis et al. |
| 7,192,713 B1 | 3/2007 | Verdine et al. |
| 7,202,332 B2 | 4/2007 | Arora et al. |
| 7,247,700 B2 | 7/2007 | Korsmeyer et al. |
| 7,538,190 B2 | 5/2009 | Robinson et al. |
| 7,666,983 B2 | 2/2010 | Halazonetis et al. |
| 7,705,118 B2 | 4/2010 | Arora et al. |
| 7,723,469 B2 | 5/2010 | Walensky et al. |
| 7,737,174 B2 | 6/2010 | Wang et al. |
| 7,745,573 B2 | 6/2010 | Robinson et al. |
| 7,759,383 B2 | 7/2010 | Wang et al. |
| 7,786,072 B2 | 8/2010 | Verdine et al. |
| 7,884,107 B2 | 2/2011 | Ma et al. |
| 7,893,278 B2 | 2/2011 | Haley et al. |
| 7,927,813 B2 | 4/2011 | Geneste et al. |
| 7,932,397 B2 | 4/2011 | Hock et al. |
| 7,960,506 B2 | 6/2011 | Nash |
| 7,964,724 B2 | 6/2011 | Fotouhi et al. |
| 7,981,998 B2 | 7/2011 | Nash |
| 7,981,999 B2 | 7/2011 | Nash |
| 8,017,607 B2 | 9/2011 | Bartkovitz et al. |
| 8,058,269 B2 | 11/2011 | Chen et al. |
| 8,071,541 B2 | 12/2011 | Arora et al. |
| 8,076,482 B2 | 12/2011 | Chen et al. |
| 8,088,815 B2 | 1/2012 | Bartkovitz et al. |
| 8,088,931 B2 | 1/2012 | Wang et al. |
| 8,124,726 B2 | 2/2012 | Robinson et al. |
| 8,198,405 B2 | 6/2012 | Walensky et al. |
| 8,217,051 B2 | 7/2012 | Zhang et al. |
| 8,288,377 B2 | 10/2012 | Storck et al. |
| 8,324,428 B2 | 12/2012 | Verdine et al. |
| 8,343,760 B2 | 1/2013 | Lu et al. |
| 8,389,484 B2 | 3/2013 | Shen et al. |
| 8,399,405 B2 | 3/2013 | Nash et al. |
| 8,524,653 B2 | 9/2013 | Nash et al. |
| 8,583,380 B2 | 11/2013 | Stephan et al. |
| 8,592,377 B2 | 11/2013 | Verdine et al. |
| 8,609,809 B2 | 12/2013 | Nash |
| 8,637,686 B2 | 1/2014 | Nash |
| 8,796,418 B2 | 8/2014 | Walensky et al. |
| 8,808,694 B2 | 8/2014 | Nash et al. |
| 8,859,723 B2 | 10/2014 | Guerlavais et al. |
| 8,871,899 B2 | 10/2014 | Wang et al. |
| 8,889,632 B2 | 11/2014 | Bernal et al. |
| 8,895,699 B2 | 11/2014 | Verdine et al. |
| 8,927,500 B2 | 1/2015 | Guerlavais et al. |
| 8,957,026 B2 | 2/2015 | Verdine et al. |
| 8,987,414 B2 | 3/2015 | Guerlavais et al. |
| 9,023,988 B2 | 5/2015 | Nash |
| 9,096,684 B2 | 8/2015 | Kawahata et al. |
| 9,163,330 B2 | 10/2015 | Verdine et al. |
| 9,175,045 B2 | 11/2015 | Nash et al. |
| 9,175,047 B2 | 11/2015 | Nash et al. |
| 9,175,056 B2 | 11/2015 | Nash |
| 9,206,223 B2 | 12/2015 | Nash et al. |
| 9,273,031 B2 | 3/2016 | Errico et al. |
| 9,273,099 B2 | 3/2016 | Walensky et al. |
| 9,371,568 B2 | 6/2016 | Gaulis et al. |
| 9,381,228 B2 | 7/2016 | Robson et al. |
| 9,394,336 B2 | 7/2016 | Nash et al. |
| 9,408,885 B2 | 8/2016 | Marine et al. |
| 9,458,189 B2 | 10/2016 | Verdine et al. |
| 9,458,202 B2 | 10/2016 | Nash et al. |
| 9,464,115 B2 | 10/2016 | Walensky et al. |
| 9,486,445 B2 | 11/2016 | Higgins et al. |
| 9,493,509 B2 | 11/2016 | Nash et al. |
| 9,505,801 B2 | 11/2016 | Verdine et al. |
| 9,505,804 B2 | 11/2016 | Guerlavais et al. |
| 9,522,947 B2 | 12/2016 | Kawahata et al. |
| 9,527,896 B2 | 12/2016 | Bernal et al. |
| 9,556,227 B2 | 1/2017 | Verdine et al. |
| 9,604,919 B2 | 3/2017 | Darlak et al. |
| 9,617,309 B2 | 4/2017 | Verdine et al. |
| 9,675,661 B2 | 6/2017 | Nash et al. |
| 9,845,287 B2 | 12/2017 | Darlak et al. |
| 9,951,099 B2 | 4/2018 | Verdine et al. |
| 9,957,296 B2 | 5/2018 | Nash et al. |
| 9,957,299 B2 | 5/2018 | Guerlavais et al. |
| 10,022,422 B2 | 7/2018 | Nash et al. |
| 10,023,613 B2 | 7/2018 | Guerlavais et al. |
| 10,030,049 B2 | 7/2018 | Nash |
| 10,059,741 B2 | 8/2018 | Annis et al. |
| 2002/0098580 A1 | 7/2002 | Nandabalan et al. |
| 2002/0132977 A1 | 9/2002 | Yuan et al. |
| 2003/0027766 A1 | 2/2003 | Ioannides et al. |
| 2003/0060432 A1 | 3/2003 | Tocque et al. |
| 2003/0144331 A1 | 7/2003 | Gudkov et al. |
| 2003/0166138 A1 | 9/2003 | Kinsella et al. |
| 2003/0176318 A1 | 9/2003 | Gudkov et al. |
| 2004/0023887 A1 | 2/2004 | Pillutla et al. |

(56) References Cited

U.S. PATENT DOCUMENTS

| | | |
|---|---|---|
| 2004/0038901 A1 | 2/2004 | Basler et al. |
| 2004/0067503 A1 | 4/2004 | Tan et al. |
| 2004/0106159 A1 | 6/2004 | Kern et al. |
| 2004/0106548 A1 | 6/2004 | Schmidt et al. |
| 2004/0115135 A1 | 6/2004 | Quay |
| 2004/0146971 A1 | 7/2004 | Lane et al. |
| 2004/0152708 A1 | 8/2004 | Li et al. |
| 2004/0170653 A1 | 9/2004 | Stanislawski et al. |
| 2004/0170971 A1 | 9/2004 | Kinzler et al. |
| 2004/0171809 A1 | 9/2004 | Korsmeyer et al. |
| 2004/0228866 A1 | 11/2004 | Lu |
| 2004/0235746 A1 | 11/2004 | Hawiger et al. |
| 2004/0248198 A1 | 12/2004 | Kriwacki et al. |
| 2004/0265931 A1 | 12/2004 | Gu et al. |
| 2005/0013820 A1 | 1/2005 | Holoshitz et al. |
| 2005/0037383 A1 | 2/2005 | Taremi et al. |
| 2005/0089511 A1 | 4/2005 | Roth et al. |
| 2005/0119167 A1 | 6/2005 | Abbenante et al. |
| 2005/0137137 A1 | 6/2005 | Lane et al. |
| 2005/0176075 A1 | 8/2005 | Jones et al. |
| 2005/0222224 A1 | 10/2005 | Gudkov et al. |
| 2005/0222427 A1 | 10/2005 | Sharpless et al. |
| 2005/0227932 A1 | 10/2005 | Lu et al. |
| 2005/0245764 A1 | 11/2005 | Yamashita et al. |
| 2005/0250680 A1 | 11/2005 | Walensky et al. |
| 2005/0277764 A1 | 12/2005 | Boyd et al. |
| 2006/0008848 A1 | 1/2006 | Verdine et al. |
| 2006/0014675 A1 | 1/2006 | Arora et al. |
| 2006/0073518 A1 | 4/2006 | Timmerman et al. |
| 2006/0100143 A1 | 5/2006 | Lu et al. |
| 2006/0111411 A1 | 5/2006 | Cooper et al. |
| 2006/0148715 A1 | 7/2006 | Tweardy |
| 2006/0149039 A1 | 7/2006 | Hunter et al. |
| 2006/0189511 A1 | 8/2006 | Koblish et al. |
| 2006/0233779 A1 | 10/2006 | Ben-Avraham et al. |
| 2006/0293380 A1 | 12/2006 | Nantermet et al. |
| 2007/0006332 A1 | 1/2007 | O'Neill |
| 2007/0020620 A1 | 1/2007 | Finn et al. |
| 2007/0032417 A1 | 2/2007 | Baell |
| 2007/0129324 A1 | 6/2007 | Boyd et al. |
| 2007/0161544 A1 | 7/2007 | Wipf et al. |
| 2007/0197772 A1 | 8/2007 | Arora et al. |
| 2007/0274915 A1 | 11/2007 | Rao et al. |
| 2008/0004286 A1 | 1/2008 | Wang et al. |
| 2008/0081038 A1 | 4/2008 | Cho et al. |
| 2008/0085279 A1 | 4/2008 | Boyd et al. |
| 2008/0132485 A1 | 6/2008 | Wang et al. |
| 2008/0161426 A1 | 7/2008 | Gudkov et al. |
| 2008/0213175 A1 | 9/2008 | Kolb et al. |
| 2008/0234183 A1 | 9/2008 | Hallbrink et al. |
| 2008/0242598 A1 | 10/2008 | Fairlie et al. |
| 2008/0250515 A1 | 10/2008 | Reed |
| 2008/0262200 A1 | 10/2008 | Nash |
| 2008/0305490 A1 | 12/2008 | Burrell et al. |
| 2008/0311608 A1 | 12/2008 | Tocque et al. |
| 2009/0047711 A1 | 2/2009 | Nash |
| 2009/0054331 A1* | 2/2009 | Chen .................. A61K 9/08 514/1.1 |
| 2009/0088553 A1 | 4/2009 | Nash |
| 2009/0149630 A1 | 6/2009 | Walensky et al. |
| 2009/0176964 A1 | 7/2009 | Walensky et al. |
| 2009/0275519 A1 | 11/2009 | Nash et al. |
| 2009/0311174 A1 | 12/2009 | Allen |
| 2009/0326192 A1 | 12/2009 | Nash et al. |
| 2010/0010065 A1 | 1/2010 | Smith |
| 2010/0081611 A1 | 4/2010 | Bradner et al. |
| 2010/0093057 A1 | 4/2010 | Beattie et al. |
| 2010/0093086 A1 | 4/2010 | Lin et al. |
| 2010/0168388 A1 | 7/2010 | Bernal et al. |
| 2010/0184628 A1 | 7/2010 | Nash |
| 2010/0184645 A1 | 7/2010 | Verdine et al. |
| 2010/0210515 A1 | 8/2010 | Nash et al. |
| 2010/0216688 A1 | 8/2010 | Nash et al. |
| 2010/0234563 A1 | 9/2010 | Arora et al. |
| 2010/0273704 A1 | 10/2010 | Korsmeyer et al. |
| 2010/0286362 A1 | 11/2010 | Boyd et al. |
| 2010/0298201 A1 | 11/2010 | Nash et al. |
| 2011/0021529 A1 | 1/2011 | Lain et al. |
| 2011/0028753 A1 | 2/2011 | Verdine et al. |
| 2011/0046043 A1 | 2/2011 | Wang et al. |
| 2011/0065915 A1 | 3/2011 | Malcolmson et al. |
| 2011/0097389 A1 | 4/2011 | Sobol et al. |
| 2011/0144303 A1 | 6/2011 | Nash et al. |
| 2011/0144306 A1 | 6/2011 | Verdine et al. |
| 2011/0183917 A1 | 7/2011 | Lu et al. |
| 2011/0218155 A1 | 9/2011 | Walensky et al. |
| 2011/0223149 A1 | 9/2011 | Nash et al. |
| 2011/0245175 A1 | 10/2011 | Arora et al. |
| 2011/0245477 A1 | 10/2011 | Hoveyda et al. |
| 2011/0250685 A1 | 10/2011 | Nash |
| 2011/0251252 A1 | 10/2011 | Wang et al. |
| 2011/0263815 A1 | 10/2011 | Nash |
| 2011/0313167 A1 | 12/2011 | Doemling |
| 2012/0040889 A1 | 2/2012 | Nash et al. |
| 2012/0082636 A1 | 4/2012 | Walensky et al. |
| 2012/0101047 A1 | 4/2012 | Nash et al. |
| 2012/0115783 A1 | 5/2012 | Nash et al. |
| 2012/0115793 A1 | 5/2012 | Nash et al. |
| 2012/0156197 A1 | 6/2012 | Errico et al. |
| 2012/0172311 A1 | 7/2012 | Nash et al. |
| 2012/0178700 A1 | 7/2012 | Nash et al. |
| 2012/0190818 A1 | 7/2012 | Nash |
| 2012/0238507 A1 | 9/2012 | Fairlie et al. |
| 2012/0264674 A1 | 10/2012 | Nash et al. |
| 2012/0264738 A1 | 10/2012 | Sugimoto et al. |
| 2012/0270800 A1 | 10/2012 | Verdine et al. |
| 2012/0283269 A1 | 11/2012 | Blagosklonny et al. |
| 2012/0328692 A1 | 12/2012 | Lu et al. |
| 2013/0005943 A1 | 1/2013 | Arora et al. |
| 2013/0023646 A1 | 1/2013 | Nash et al. |
| 2013/0072439 A1 | 3/2013 | Nash et al. |
| 2013/0123196 A1 | 5/2013 | Arora et al. |
| 2013/0177979 A1 | 7/2013 | Turkson |
| 2013/0210743 A1 | 8/2013 | Guerlavais et al. |
| 2013/0210745 A1 | 8/2013 | Guerlavais et al. |
| 2013/0211046 A1 | 8/2013 | Verdine et al. |
| 2013/0274205 A1 | 10/2013 | Guerlavais et al. |
| 2013/0330421 A1 | 12/2013 | Marine et al. |
| 2013/0333419 A1 | 12/2013 | Koketsu et al. |
| 2014/0005118 A1 | 1/2014 | Verdine et al. |
| 2014/0011979 A1 | 1/2014 | Verdine et al. |
| 2014/0018302 A1 | 1/2014 | Walensky et al. |
| 2014/0051828 A1 | 2/2014 | Arora et al. |
| 2014/0128581 A1 | 5/2014 | Darlak et al. |
| 2014/0141980 A1 | 5/2014 | Stephan et al. |
| 2014/0162339 A1 | 6/2014 | Verdine et al. |
| 2014/0235549 A1 | 8/2014 | Moellering et al. |
| 2014/0256912 A1 | 9/2014 | Moellering et al. |
| 2014/0296160 A1 | 10/2014 | Walensky et al. |
| 2014/0323701 A1 | 10/2014 | Nash et al. |
| 2014/0378390 A1 | 12/2014 | Guerlavais et al. |
| 2015/0004158 A1 | 1/2015 | Shipp et al. |
| 2015/0038430 A1 | 2/2015 | Nash et al. |
| 2015/0039946 A1 | 2/2015 | Rao et al. |
| 2015/0051155 A1 | 2/2015 | Guerlavais et al. |
| 2015/0056612 A1 | 2/2015 | Shen et al. |
| 2015/0119551 A1 | 4/2015 | Bernal et al. |
| 2015/0157603 A1 | 6/2015 | Higgins et al. |
| 2015/0183825 A1 | 7/2015 | Guerlavais et al. |
| 2015/0225471 A1 | 8/2015 | Liang et al. |
| 2015/0239937 A1 | 8/2015 | Verdine et al. |
| 2015/0284437 A1 | 10/2015 | Verdine et al. |
| 2015/0285810 A1 | 10/2015 | Lu et al. |
| 2015/0376227 A1 | 12/2015 | Verdine et al. |
| 2016/0024153 A1 | 1/2016 | Verdine et al. |
| 2016/0030433 A1 | 2/2016 | Koff et al. |
| 2016/0031936 A1 | 2/2016 | Nash |
| 2016/0038498 A1 | 2/2016 | Bussey et al. |
| 2016/0052970 A1 | 2/2016 | Guerlavais et al. |
| 2016/0068573 A1 | 3/2016 | Nash et al. |
| 2016/0095896 A1 | 4/2016 | Nash |
| 2016/0096873 A1 | 4/2016 | Nash et al. |
| 2016/0108089 A1 | 4/2016 | Nash et al. |
| 2016/0115204 A1 | 4/2016 | Nash et al. |

(56) References Cited

U.S. PATENT DOCUMENTS

| | | | |
|---|---|---|---|
| 2016/0115553 A1 | 4/2016 | Stephan et al. |
| 2016/0115554 A1 | 4/2016 | Stephan et al. |
| 2016/0115556 A1 | 4/2016 | Erlander et al. |
| 2016/0122830 A1 | 5/2016 | Stephan et al. |
| 2016/0137710 A1 | 5/2016 | Kawahata et al. |
| 2016/0193283 A1 | 7/2016 | Chen et al. |
| 2016/0215036 A1 | 7/2016 | Verdine et al. |
| 2016/0244494 A1 | 8/2016 | Verdine et al. |
| 2016/0250278 A1 | 9/2016 | Nash et al. |
| 2016/0251399 A1 | 9/2016 | Nash et al. |
| 2016/0257716 A1 | 9/2016 | Guerlavais et al. |
| 2016/0257725 A1 | 9/2016 | Verdine et al. |
| 2016/0265065 A1 | 9/2016 | Bandla et al. |
| 2016/0287569 A1 | 10/2016 | Caenepeel et al. |
| 2016/0289274 A1 | 10/2016 | Nash |
| 2016/0289770 A1 | 10/2016 | Gaulis et al. |
| 2016/0304564 A1 | 10/2016 | Nash |
| 2016/0333049 A1 | 11/2016 | Chen et al. |
| 2016/0339023 A1 | 11/2016 | Li et al. |
| 2016/0362749 A1 | 12/2016 | Stephan et al. |
| 2017/0002042 A1 | 1/2017 | Annis et al. |
| 2017/0008930 A1 | 1/2017 | Walensky et al. |
| 2017/0015716 A1 | 1/2017 | Walensky et al. |
| 2017/0037086 A1 | 2/2017 | Kawahata et al. |
| 2017/0037105 A1 | 2/2017 | Samant |
| 2017/0066714 A1 | 3/2017 | Darlak et al. |
| 2017/0066799 A1 | 3/2017 | Verdine et al. |
| 2017/0081379 A1 | 3/2017 | Bernal et al. |
| 2017/0088581 A1 | 3/2017 | Verdine et al. |
| 2017/0281720 A1 | 10/2017 | Guerlavais et al. |
| 2017/0296620 A1 | 10/2017 | Nash |
| 2017/0298099 A1 | 10/2017 | Nash et al. |
| 2017/0360881 A1 | 12/2017 | Samant et al. |
| 2018/0085426 A1 | 3/2018 | Nash et al. |
| 2018/0100001 A1 | 4/2018 | Verdine et al. |

FOREIGN PATENT DOCUMENTS

| | | |
|---|---|---|
| CN | 1583730 A | 2/2005 |
| CN | 1906209 A | 1/2007 |
| CN | 101244053 A | 8/2008 |
| CN | 101636407 A | 1/2010 |
| CN | 102223891 A | 10/2011 |
| CZ | 9700369 A3 | 9/1998 |
| EP | 0467699 A2 | 1/1992 |
| EP | 0467699 A3 | 2/1993 |
| EP | 0528312 A2 | 2/1993 |
| EP | 0552417 A1 | 7/1993 |
| EP | 0729972 A1 | 9/1996 |
| EP | 0643726 B1 | 8/1999 |
| EP | 0977580 B1 | 4/2003 |
| EP | 1321474 A1 | 6/2003 |
| EP | 1452868 A2 | 9/2004 |
| EP | 1541692 A1 | 6/2005 |
| EP | 1602663 A1 | 12/2005 |
| EP | 1609802 A1 | 12/2005 |
| EP | 1243923 B1 | 3/2006 |
| EP | 1180016 B1 | 9/2006 |
| EP | 0958305 B1 | 6/2008 |
| EP | 2310407 A2 | 4/2011 |
| EP | 1597585 B1 | 6/2011 |
| EP | 2377849 A2 | 10/2011 |
| EP | 2637680 A2 | 9/2013 |
| EP | 3027212 A1 | 6/2016 |
| EP | 2474624 B1 | 8/2016 |
| EP | 3059322 A1 | 8/2016 |
| EP | 2474625 B1 | 11/2016 |
| EP | 2245464 B1 | 12/2016 |
| JP | 2002524391 A | 8/2002 |
| JP | 2008501623 A | 1/2008 |
| JP | 2010518017 A | 5/2010 |
| JP | 2010120881 A | 6/2010 |
| JP | 2010519318 A | 6/2010 |
| JP | 2012503025 A | 2/2012 |
| WO | WO-8909233 A1 | 10/1989 |
| WO | WO-8912675 A1 | 12/1989 |
| WO | WO-9206998 A1 | 4/1992 |
| WO | WO-9213878 A2 | 8/1992 |
| WO | WO-9301203 A1 | 1/1993 |
| WO | WO-9307170 A1 | 4/1993 |
| WO | WO-9422910 A1 | 10/1994 |
| WO | WO-9425482 A1 | 11/1994 |
| WO | WO-9500534 A1 | 1/1995 |
| WO | WO-9522546 A1 | 8/1995 |
| WO | WO-9602642 A1 | 2/1996 |
| WO | WO-9620951 A1 | 7/1996 |
| WO | WO-9628449 A1 | 9/1996 |
| WO | WO-9634878 A1 | 11/1996 |
| WO | WO-9700267 A1 | 1/1997 |
| WO | WO-9713537 A1 | 4/1997 |
| WO | WO-9714794 A1 | 4/1997 |
| WO | WO-9726002 A1 | 7/1997 |
| WO | WO-9730072 A1 | 8/1997 |
| WO | WO-9737705 A1 | 10/1997 |
| WO | WO-9801467 A2 | 1/1998 |
| WO | WO-9817625 A1 | 4/1998 |
| WO | WO-9846631 A1 | 10/1998 |
| WO | WO-9847525 A1 | 10/1998 |
| WO | WO-9851707 A1 | 11/1998 |
| WO | WO-9914259 A1 | 3/1999 |
| WO | WO-9934833 A1 | 7/1999 |
| WO | WO-9934850 A1 | 7/1999 |
| WO | WO-9963929 A2 | 12/1999 |
| WO | WO-0006187 A2 | 2/2000 |
| WO | WO-0006187 A3 | 5/2000 |
| WO | WO-02064790 A2 | 8/2002 |
| WO | WO-02070547 A1 | 9/2002 |
| WO | WO-02072597 A2 | 9/2002 |
| WO | WO-02064790 A3 | 5/2003 |
| WO | WO-03054000 A1 | 7/2003 |
| WO | WO-03059933 A2 | 7/2003 |
| WO | WO-03070892 A2 | 8/2003 |
| WO | WO-03102538 A2 | 12/2003 |
| WO | WO-03106491 A2 | 12/2003 |
| WO | WO-03059933 A3 | 1/2004 |
| WO | WO-2004026896 A2 | 4/2004 |
| WO | WO-2004037754 A2 | 5/2004 |
| WO | WO-2004041275 A1 | 5/2004 |
| WO | WO-2004058804 A1 | 7/2004 |
| WO | WO-2004077062 A2 | 9/2004 |
| WO | WO-2004037754 A3 | 10/2004 |
| WO | WO-03070892 A3 | 11/2004 |
| WO | WO-03106491 A3 | 12/2004 |
| WO | WO-2004077062 A3 | 1/2005 |
| WO | WO-2005007675 A2 | 1/2005 |
| WO | WO-2004077062 B1 | 2/2005 |
| WO | WO-2005012335 A1 | 2/2005 |
| WO | WO-2005040202 A2 | 5/2005 |
| WO | WO-2005044839 A2 | 5/2005 |
| WO | WO-2005040202 A3 | 6/2005 |
| WO | WO-2005007675 A3 | 7/2005 |
| WO | WO-2005044839 A3 | 7/2005 |
| WO | WO-2005074521 A2 | 8/2005 |
| WO | WO-2005085457 A2 | 9/2005 |
| WO | WO-2005090388 A1 | 9/2005 |
| WO | WO-2005118620 A2 | 12/2005 |
| WO | WO-2005118625 A1 | 12/2005 |
| WO | WO-2005118634 A2 | 12/2005 |
| WO | WO-2005118634 A3 | 5/2006 |
| WO | WO-2005118620 A3 | 6/2006 |
| WO | WO-2006078161 A1 | 7/2006 |
| WO | WO-2006103666 A2 | 10/2006 |
| WO | WO-2006137974 A2 | 12/2006 |
| WO | WO-2006103666 A3 | 3/2007 |
| WO | WO-2007141533 A2 | 12/2007 |
| WO | WO-2008013454 A2 | 1/2008 |
| WO | WO-2008014216 A1 | 1/2008 |
| WO | WO-2008045238 A2 | 4/2008 |
| WO | WO-2008061192 A2 | 5/2008 |
| WO | WO-2008074895 A1 | 6/2008 |
| WO | WO-2008076904 A1 | 6/2008 |
| WO | WO-2007141533 A3 | 7/2008 |
| WO | WO-2008061192 A3 | 7/2008 |
| WO | WO-2008092281 A1 | 8/2008 |

(56) References Cited

FOREIGN PATENT DOCUMENTS

| | | |
|---|---|---|
| WO | WO-2008095063 A1 | 8/2008 |
| WO | WO-2008104000 A2 | 8/2008 |
| WO | WO-2008106507 A2 | 9/2008 |
| WO | WO-2008121767 A2 | 10/2008 |
| WO | WO-2008104000 A3 | 11/2008 |
| WO | WO-2008137633 A2 | 11/2008 |
| WO | WO-2008121767 A3 | 1/2009 |
| WO | WO-2009042237 A2 | 4/2009 |
| WO | WO-2009089004 A1 | 7/2009 |
| WO | WO-2009099677 A2 | 8/2009 |
| WO | WO-2009110952 A2 | 9/2009 |
| WO | WO-2009126292 A2 | 10/2009 |
| WO | WO-2009137532 A1 | 11/2009 |
| WO | WO-2009149214 A2 | 12/2009 |
| WO | WO-2009149339 A2 | 12/2009 |
| WO | WO-2010011313 A2 | 1/2010 |
| WO | WO-2010013011 A1 | 2/2010 |
| WO | WO-2010033617 A2 | 3/2010 |
| WO | WO-2010033879 A2 | 3/2010 |
| WO | WO-2010034026 A1 | 3/2010 |
| WO | WO-2010034028 A1 | 3/2010 |
| WO | WO-2010034029 A1 | 3/2010 |
| WO | WO-2010034031 A1 | 3/2010 |
| WO | WO-2010034032 A2 | 3/2010 |
| WO | WO-2010034034 A1 | 3/2010 |
| WO | WO-2010058819 A1 | 5/2010 |
| WO | WO-2010060112 A1 | 5/2010 |
| WO | WO-2010068684 A2 | 6/2010 |
| WO | WO-2010083347 A2 | 7/2010 |
| WO | WO-2010083501 A2 | 7/2010 |
| WO | WO-2010100351 A1 | 9/2010 |
| WO | WO-2010107485 A1 | 9/2010 |
| WO | WO-2010011313 A3 | 12/2010 |
| WO | WO-2011005219 A1 | 1/2011 |
| WO | WO-2011008260 A2 | 1/2011 |
| WO | WO-2011008260 A3 | 3/2011 |
| WO | WO-2011023677 A1 | 3/2011 |
| WO | WO-2011038049 A1 | 3/2011 |
| WO | WO-2011047215 A1 | 4/2011 |
| WO | WO-2011060049 A2 | 5/2011 |
| WO | WO-2011061139 A1 | 5/2011 |
| WO | WO-2011076786 A1 | 6/2011 |
| WO | WO-2011090297 A2 | 7/2011 |
| WO | WO-2011101297 A1 | 8/2011 |
| WO | WO-2011106650 A2 | 9/2011 |
| WO | WO-2011161699 A2 | 12/2011 |
| WO | WO-2012016186 A1 | 2/2012 |
| WO | WO-2012021874 A1 | 2/2012 |
| WO | WO-2012021875 A1 | 2/2012 |
| WO | WO-2012021876 A2 | 2/2012 |
| WO | WO-2012033525 A2 | 3/2012 |
| WO | WO-2012034954 A1 | 3/2012 |
| WO | WO-2012038307 A1 | 3/2012 |
| WO | WO-2012040459 A2 | 3/2012 |
| WO | WO-2012045018 A1 | 4/2012 |
| WO | WO-2012047587 A2 | 4/2012 |
| WO | WO-2012051405 A1 | 4/2012 |
| WO | WO-2012059696 A1 | 5/2012 |
| WO | WO-2012065022 A1 | 5/2012 |
| WO | WO-2012065181 A2 | 5/2012 |
| WO | WO-2012066095 A1 | 5/2012 |
| WO | WO-2012040459 A3 | 6/2012 |
| WO | WO-2012076513 A1 | 6/2012 |
| WO | WO-2012080376 A1 | 6/2012 |
| WO | WO-2012080389 A1 | 6/2012 |
| WO | WO-2012083078 A2 | 6/2012 |
| WO | WO-2012083181 A1 | 6/2012 |
| WO | WO-2012121057 A1 | 9/2012 |
| WO | WO-2012122059 A1 | 9/2012 |
| WO | WO-2012149563 A1 | 11/2012 |
| WO | WO-2012173846 A2 | 12/2012 |
| WO | WO-2012174423 A1 | 12/2012 |
| WO | WO-2012175962 A1 | 12/2012 |
| WO | WO-2013033645 A1 | 3/2013 |
| WO | WO-2013036208 A1 | 3/2013 |
| WO | WO-2013049250 A1 | 4/2013 |
| WO | WO-2013059525 A1 | 4/2013 |
| WO | WO-2013059530 A2 | 4/2013 |
| WO | WO-2013062923 A1 | 5/2013 |
| WO | WO 2013/123266 * | 8/2013 |
| WO | WO-2013123267 A1 | 8/2013 |
| WO | WO-2014020502 A2 | 2/2014 |
| WO | WO-2014052647 A2 | 4/2014 |
| WO | WO-2014055564 A1 | 4/2014 |
| WO | WO-2014071241 A1 | 5/2014 |
| WO | WO-2014138429 A2 | 9/2014 |
| WO | WO-2014144121 A2 | 9/2014 |
| WO | WO-2015000945 A1 | 1/2015 |
| WO | WO-2015108175 A1 | 7/2015 |
| WO | WO-2015157508 A1 | 10/2015 |
| WO | WO-2015179799 A1 | 11/2015 |
| WO | WO-2015198266 A1 | 12/2015 |
| WO | WO-2016040892 A1 | 3/2016 |
| WO | WO-2016049355 A1 | 3/2016 |
| WO | WO-2016049359 A1 | 3/2016 |
| WO | WO-2016055497 A1 | 4/2016 |
| WO | WO-2016056673 A1 | 4/2016 |
| WO | WO-2016073184 A1 | 5/2016 |
| WO | WO-2016105503 A1 | 6/2016 |
| WO | WO-2016154058 A1 | 9/2016 |
| WO | WO-2017004548 A1 | 1/2017 |
| WO | WO-2017004591 A2 | 1/2017 |
| WO | WO-2017023933 A2 | 2/2017 |
| WO | WO-2017040990 A1 | 3/2017 |
| WO | WO-2017044633 A1 | 3/2017 |
| WO | WO-2017205786 A1 | 11/2017 |
| WO | WO-2017218949 A2 | 12/2017 |
| WO | WO-2018165575 A2 | 9/2018 |

OTHER PUBLICATIONS

Colacino, et al. Evaluation of the anti-influenza virus activities of 1,3,4-thiadiazol-2-ylcyanamide (LY217896) and its sodium salt. Antimicrob Agents Chemother. Nov. 1990;34(11):2156-63.
Co-pending U.S. Appl. No. 15/074,794, filed Mar. 18, 2016.
Co-pending U.S. Appl. No. 15/093,335, filed Apr. 7, 2016.
Co-pending U.S. Appl. No. 15/093,373, filed Apr. 7, 2016.
Co-pending U.S. Appl. No. 15/093,426, filed Apr. 7, 2016.
Co-pending U.S. Appl. No. 15/093,869, filed Apr. 8, 2016.
Co-pending U.S. Appl. No. 15/278,824, filed Sep. 28, 2016.
Edlund, et al. Data-driven unbiased curation of the TP53 tumor suppressor gene mutation database and validation by ultradeep sequencing of human tumors. PNAS Early Edition, pp. 1-20, 2012.
European search report and search opinion dated May 20, 2016 for EP Application No. 13851076.3.
European search report and search opinion dated Sep. 30, 3015 for EP Application No. 13749501-6.
European search report and search opinion dated Nov. 6, 2015 for EP Application No. 15154235-4.
Fischer, P. Peptide, Peptidomimetic, and Small-molecule Antagonists of the p53-HDM2 Protein-Protein Interaction. Int J Pept Res Ther. Mar. 2006;12(1):3-19. Epub Mar. 15, 2006.
Folkers, et al. Methods and principles in medicinal chemistry. Eds. R. Mannhold, H. Kubinyi, and H. Timmerman. Wiley-VCH, 2001, p. 1-406.
Grubbs, et al. Ring-Closing Metathesis and Related Processes in Organic Synthesis. Acc. Chem. Res., 1995, 28 (11), pp. 446-452.
Guerlavais, et al. Advancements in Stapled Peptide Drug Discovery & Development. Annual Reports in Medicinal Chemistry, vol. 49, 331-345, 2014.
Hemerka, et al. Detection and characterization of influenza A virus PA-PB2 interaction through a bimolecular fluorescence complementation assay. J Virol. Apr. 2009;83(8):3944-55. doi: 10.1128/JVI.02300-08. Epub Feb. 4, 2009.
Hessa, et al. Recognition of transmembrane helices by the endoplasmic reticulum translocon. Nature. Jan. 27, 2005;433(7024):377-81.
International search report and written opinion dated Feb. 9, 2016 for PCT Application No. PCT/US2015/052018.

(56) References Cited

OTHER PUBLICATIONS

International search report and written opinion dated May 9, 2016 for PCT Application No. PCTUS2016/023275.
International search report and written opinion dated Dec. 4, 2015 for PCT Application No. PCT/US2015/052031.
Li; et al., "A versatile platform to analyze low-affinity and transient protein-protein interactions in living cells in real time." 2014, 9(5):1946-58.
Lohmar et al. Synthese symmetrischerf ketone unter verwendung von 2-Phenyl-2-oxazolin-5-on. (α-Aminosäuren als nucleophile Acyläquivalente, IV.) Chemische Berichte. 1980;113(12):3706-15.
Morita, et al. Cyclolinopeptides B-E, new cyclic peptides from Linum usitatissimum. Tetrahedron 55.4 (1999): 967-976.
Mustapa, et al. Synthesis of a cyclic peptide containing norlanthionine: effect of the thioether bridge on peptide conformation. J Org Chem. Oct. 17, 2003;68(21):8193-8.
Noah, et al. A cell-based luminescence assay is effective for high-throughput screening of potential influenza antivirals. Antiviral Res. Jan. 2007;73(1):50-9. Epub Jul. 28, 2006.
Notice of allowance dated May 18, 2016 for U.S. Appl. No. 14/070,354.
Notice of allowance dated Jun. 1, 2016 for U.S. Appl. No. 14/070,354.
Notice of allowance dated Jul. 18, 2016 for U.S. Appl. No. 14/498,063.
Notice of allowance dated Jul. 19, 2016 for U.S. Appl. No. 14/068,844.
Notice of allowance dated Jul. 21, 2016 for U.S. Appl. No. 14/677,679.
Notice of allowance dated Jul. 28, 2016 for U.S. Appl. No. 14/498,063.
Notice of allowance dated Aug. 16, 2016 for U.S. Appl. No. 14/483,905.
Notice of allowance dated Oct. 23, 2015 for U.S. Appl. No. 13/252,751.
Office action dated Jan. 14, 2016 for U.S. Appl. No. 14/027,064.
Office action dated Jan. 29, 2016 for U.S. Appl. No. 14/483,905.
Office action dated Apr. 28, 2016 for U.S. Appl. No. 14/677,679.
Office action dated Jun. 6, 2016for U.S. Appl. No. 14/608,641.
Office action dated Sep. 20, 2016 for U.S. Appl. No. 14/852,368.
Office action dated Oct. 4, 2016 for U.S. Appl. No. 14/864,801.
Office action dated Oct. 24, 2016 for U.S. Appl. No. 14/718,288.
Office action dated Oct. 26, 2015 for U.S. Appl. No. 14/460,848.
Office action dated Nov. 16, 2015 for U.S. Appl. No. 14/070,354.
Office action dated Dec. 7, 2015 for U.S. Appl. No. 14/677,679.
Office action dated Dec. 23, 2015 for U.S. Appl. No. 14/498,063.
Peryshkov, et al. Z-Selective olefin metathesis reactions promoted by tungsten oxo alkylidene complexes. J Am Chem Soc. Dec. 28, 2011;133(51):20754-7.
Picksley et al., Immunochemical analysis of the interaction of p53 with MDM2;—fine mapping of the MDM2 binding site on p53 using synthetic peptides. Oncogene. Sep. 1994;9(9):2523-9.
Remington: The Science and Practice of Pharmacy. 19th Edition, 1995, 11 pages.
Rivlin, et al. Mutations in the p53 Tumor Suppressor Gene: Important Milestones at the Various Steps of Tumorigenesis. Genes & Cancer 2011, 2:466. Originally published online May 18, 2011.
Roice, et al. High Capacity Poly(ethylene glycol) Based Amino Polymers for Peptide and Organic Synthesis. QSAR & Combinatorial Science. 2004;23(8):662-673.
Sawyer, et al. Macrocyclic a-Helical Peptide Drug Discovery. Macrocycles in Drug Discovery, 40 (2014): 339-366.
Schafmeister et al. An all-hydrocarbon crosslinking system for enhancing the helicity and metabolic stability of peptides. J. Am Chem. Soc. 2000 122:5891-5892.
Thallinger, et al. Mcl-1 is a novel therapeutic target for human sarcoma: synergistic inhibition of human sarcoma xenotransplants by a combination of mcl-1 antisense oligonucleotides with low-dose cyclophosphamide. Clin Cancer Res. Jun. 15, 2004;10(12 Pt 1):4185-91.
Uesugi et al., The alpha-helical FXXPhiPhi motif in p53: TAF interaction and discrimination by MDM2. Proc Natl Acad Sci USA. Dec. 21, 1999;96(26):14801-6.
Vaickus et al., Immune markers in hematologic malignancies. Crit Rev Oncol Hematol. Dec. 1991; 11(4):267-97.
Vila-Perello, et al. A minimalist design approach to antimicrobial agents based on a thionin template. J Med Chem. Jan. 26, 2006;49(2):448-51.
Walensky, et al. A stapled BID BH3 helix directly binds and activates BAX. Mol. Cell. Oct. 20, 2006;24(2):199-210.
Walensky, et al. Activation of apoptosis in vivo by a hydrocarbon-stapled BH3 helix. Science. Sep. 3, 2004;305(5689):1466-70.
Website: http://www.onelook.com/?w=span&ls=a&loc=home_ac_span, 1 page, Retrieved on Jan. 23, 2016.
Wenninger, et al. International Cosmetic Ingredient Dictionary and Handbook. vol. 2, 7th Edition, 1997, published by the Cosmetic, Toiletry, and Fragrance Association, 3 pages.
Yang et al. Synthesis and helical structure of lactam bridged BH3 peptides derived from pro-apoptotic Bcl-2 family proteins. Bioorg Med Chem Lett. Mar. 22, 2004;14(6)1 403-6.
Zhang, et al. Targeting p53-MDM2-MDMX loop for cancer therapy. Subcell Biochem. 2014;85:281-319. doi: 10.1007/978-94-017-9211-0_16.
Zitzow, et al. Pathogenesis of avian influenza A (H5N1) viruses in ferrets. J Virol. May 2002;76(9):4420-9.
Co-pending U.S. Appl. No. 15/711,576, filed Sep. 21, 2017.
Walensky, et al. Hydrocarbon-stapled peptides: principles, practice, and progress. J Med Chem. Aug. 14, 2014;57(15):6275-88. doi: 10.1021/jm4011675. Epub Mar. 6, 2014.
Adams, et al. The Bcl-2 apoptotic switch in cancer development and therapy. Oncogene. Feb. 26, 2007; 26(9): 1324-1337.
Co-pending U.S. Appl. No. 15/956,333, filed Apr. 18, 2018.
Co-pending U.S. Appl. No. 15/794,355, filed Oct. 26, 2017.
Co-pending U.S. Appl. No. 15/917,560, filed Mar. 9, 2018.
Crook, et al. Degradation of p53 can be targeted by HPV E6 sequences distinct from those required for p53 binding and trans-activation. Cell. Nov. 1, 1991;67(3):547-56.
Designing Custom Peptides from SIGMA Genosys, p. 1. Accessed Jul. 27, 2012.
Merck Manual Breast Cancer accessed Aug. 21, 2014 at URL:merckmanuals.com/home/womens_health_issues/breast disorders/breast_cancer.html. 20 pages.
Nahi, et al. Mutated and non-mutated TP53 as targets in the treatment of leukaemia. Br J Haematol. May 2008;141(4):445-53.
Notice of allowance dated Dec. 12, 2017 for U.S. Appl. No. 15/287,513.
Office action dated Jan. 17, 2018 for U.S. Appl. No. 14/608,641.
Office action dated Nov. 24, 2017 for U.S. Appl. No. 15/135,098.
Overview of Leukemia. Merck Manuals. Aug. 20, 2014. merckmanuals.com/home/blood_disorders!leukemias/overview_of_leukemia.html?qt=Leukemia&alt=sh. 2 pages.
PCT/US2016/023275 International Preliminary Report on Patentability dated Oct. 5, 2017.
Uppsala Software Factory—Typical bond lengths. Latest update at Fri Jul. 11 23:24:54 1997 by TABLE2HTML version 970219/0.5 http://www.greeley.org/-hod/papers/typical_bonds.html [Apr. 8, 2018 11:12:57 AM] (Year: 1997).
U.S. Appl. No. 14/921,573 Office Action dated May 11, 2018.
U.S. Appl. No. 15/074,794 Office Action dated May 11, 2018.
U.S. Appl. No. 15/093,426 Notice of Allowance dated Feb. 27, 2018.
U.S. Appl. No. 15/093,426 Office action dated Jan. 8, 2018.
U.S. Appl. No. 15/093,869 Office action dated Jan. 22, 2018.
U.S. Appl. No. 15/135,098 Notice of Allowance dated Jan. 25, 2018.
U.S. Appl. No. 15/229,517 Office Action dated Mar. 20, 2018.
Zhu, et al. Mechanisms of relapse in acute leukaemia: involvement of p53 mutated subclones in disease progression in acute lymphoblastic leukaemia. Br J Cancer. Mar. 1999;79(7-8):1151-7.
Abbas, et al. (2010). Mdm2 is required for survival of hematopoietic stem cells/progenitors via dampening of ROS-induced p53 activity. Cell Stem Cell 7, 606-617.
Abraham, et al. (2016). Dual targeting of p53 and c-MYC selectively eliminates leukaemic stem cells. Nature 534, 341-346.
Adhikary et al., Transcriptional regulation and transformation by Myc proteins. Nat Rev Mol Cell Biol. Aug. 2005;6(8):635-45.
Agola et al., Rab GTPases as regulators of endocytosis, targets of disease and therapeutic opportunities. Clin Genet. Oct. 2011; 80(4): 305-318.

(56) References Cited

OTHER PUBLICATIONS

Ahn, et al. A convenient method for the efficient removal of ruthenium byproducts generated during olefin metathesis reactions. Organic Letters. 2001; 3(9):1411-1413.

Akala, et al. (2008). Long-term haematopoietic reconstitution by Trp53-/-p16Ink4a-/-p19Arf-/-multipotent progenitors. Nature 453, 228-232.

Al-Lazikani, et al. Combinatorial drug therapy for cancer in the post-genomic era. Nature biotechnology 30.7 (2012): 679-692.

Altschul et al. Basic local alignment search tool. J Mol Biol215(3):403-410 (1990).

Aman et al., cDNA cloning and characterization of the human interleukin 13 receptor alpha chain. J Biol Chem. Nov. 15, 1996;271(46):29265-70.

Andreeff, et al. (2016). Results of the Phase I Trial of RG7112, a Small-Molecule MDM2 Antagonist in Leukemia. Clin Cancer Res 22, 868-876.

Andrews et al. Forming Stable Helical Peptide Using Natural and Artificial Amino Acids. Tetrahedron. 1999;55:11711-11743.

Andrews et al., Kinetic analysis of the interleukin-13 receptor complex. J Biol Chem. Nov. 29, 2002;277(48):46073-8. Epub Sep. 26, 2002.

Angel & Karin, The Role of Jun, Fos and the AP-1 Complex in Cell-proliferation and Transformation, Biochim. Biophys. Acta 1072:129-157 (1991).

Angell, et al. Peptidomimetics via copper-catalyzed azide-alkyne cycloadditions. Chem Soc Rev. Oct. 2007;36(10):1674-89.

Angell, et al. Ring closure to beta-turn mimics via copper-catalyzed azide/alkyne cycloadditions. J Org Chem. Nov. 11, 2005;70(23):9595-8.

Annis, et al. A general technique to rank protein-ligand binding affinities and determine allosteric versus direct binding site competition in compound mixtures. J Am Chem Soc. Dec. 1, 2004;126(47):15495-503.

Annis, et al. ALIS: An Affinity Selection-Mass Spectrometry System for the Discovery and Characterization of Protein-Ligand Interactions. In: Wanner, K. and Höfner, G. eds. Mass Spectrometry in Medicinal Chemistry. Wiley-VCH; 2007:121-156.

Armstrong et al., X = Y-ZH Systems as potential 1,3-dipoles. 5. Intramolecular cycloadditions of imines of a-amino acid esters. Tetrahedron. 1985;41(17):3547-58.

Arora, Design, Synthesis, and Properties of the Hydrogen Bond Surrogate-based Artificial Alpha-helices, American Chemical Society Meeting, San Diego (Mar. 2005) (oral).

Arora, Hydrogen Bond Surrogate Approach for the Synthesis of Short α-Helical Peptides, American Chemical Society Meeting, Philadelphia (Aug. 2004) (abstract of oral presentation).

Arosio, et al. Click chemistry to functionalise peptidomimetics. Tetrahedron Letters. 2006; 47:3697-3700.

Artavanis-Tsakonas et al., Notch signaling: cell fate control and signal integration in development. Science. Apr. 30, 1999;284(5415):770-6.

Asai, et al. (2012). Necdin, a p53 target gene, regulates the quiescence and response to genotoxic stress of hematopoietic stem/progenitor cells. Blood 120, 1601-1612.

Attisano et al., TGFbeta and Wnt pathway cross-talk. Cancer Metastasis Rev. Jan.-Jun. 2004;23(1-2):53-61.

Austin et al., A Template for Stabilization of a Peptide α-Helix: Synthesis and Evaluation of Conformational Effects by Circular Dichroism and NMR, J. Am. Chem. Soc. 119:6461-6472 (1997).

Babcock, Proteins, radicals, isotopes, and mutants in photosynthetic oxygen evolution. Proc Natl Acad Sci U S A. Dec. 1, 1993;90(23)10893-5.

Babine et aL, Molecular Recognition of Proteinminus signLigand Complexes: Applications to Drug Design. Chem Rev. Aug. 5, 1997;97(5):1359-1472.

Badyal, et al. A Simple Method for the Quantitative Analysis of Resin Bound Thiol Groups. Tetrahedron Lett. 2001; 42:8531-33.

Baell, J.B. Prospects for Targeting the Bcl-2 Family of Proteins to Develop Novel cytotoxic drugs. Biochem Pharmacol. Sep. 2002;64(5-6):851-63.

Bakhshi, et al. Cloning the chromosomal breakpoint of t(14;18) human lymphomas: clustering around JH on chromosome 14 and near a transcriptional unit on 18. Cell. Jul. 1985;41(3):899-906.

Balof, et al. Olefin metathesis catalysts bearing a pH-responsive NHC ligand: a feasible approach to catalyst separation from RCM products. Dalton Trans. Nov. 14, 2008;(42):5791-9. doi: 10.1039/b809793c. Epub Sep. 12, 2008.

Balthaser et al., Remodelling of the natural product fumagillol employing a reaction discovery approach. Nat Chem. Dec. 2011;3(12):969-73.

Banerjee et aL, Structure of a DNA glycosylase searching for lesions. Science. Feb. 24, 2006;311(5764):1153-7.

Banerjee et al., Structure of a repair enzyme interrogating undamaged DNA elucidates recognition of damaged DNA. Nature. Mar. 31, 2005;434(7033):612-8.

Banerji et al. Synthesis of Cyclic β-Turn Mimics from L-Pro-Phe/Phe-L-Pro Derived Di- and Tripeptides via Ring Closing Metathesis: The Role of Chirality of the Phe Residue During Cyclization. Tetrahedron Lett. 2002; 43:6473-6477.

Bang et al., Total chemical synthesis of crambin. J Am Chem Soc. Feb. 11, 2004;126(5):1377-83.

Barandon et al., Reduction of infarct size and prevention of cardiac rupture in transgenic mice overexpressing FrzA. Circulation. Nov. 4, 2003;108(18):2282-9. Epub Oct. 27, 2003.

Barker, et al. Cyclic RGD peptide analogues as antiplatelet antithrombotics. J Med Chem. May 29, 1992;35(11):2040-8. (Abstract only).

Barker et al., Mining the Wnt pathway for cancer therapeutics. Nat Rev Drug Discov. Dec. 2006;5(12):997-1014.

Barreyro, et al. (2012). Overexpression of IL-1 receptor accessory protein in stem and progenitor cells and outcome correlation in AML and MDS. Blood 120, 1290-1298.

Belokon et al., Chiral Complexes of Ni(II), Cu(II) and Cu(I) as Reagents, Catalysts and Receptors for Asymmetric Synthesis and Chiral Recognition of Amino Acids. Pure & Appl Chem. 1992;64(12):1917-24.

Belokon et al., Improved procedures for the synthesis of (S)-21N-(N'-benzyl-prolypaminolbenzophenone (BPB) and Ni(II) complexes of Schiff's bases derived from BPB and amino acids. Tetrahedron: Asymmetry. 1998;9:4249-52.

Belokon, Y. N., et al., Halo-substituted (S)-N-(2-benzoylphenyl)-1-benzylpyrolidine-2 carboxamides as new chiral auxiliaries for the asymmetric synthesis of (S)-a-amino acids,Russian Chemical Bulletin, International Edition, 51 (8): 1593-1599 (2002.

Bennett, et al. Regulation of osteoblastogenesis and bone mass by Wntl Ob. Proc Natl Acad Sci U S A. Mar. 1, 2005;102(9):3324-9.. Epub Feb. 22, 2005.

Berendsen et al. A glimpse of the Holy Grail? Science 282(5389):642-643 (1998).

Berezowska; et al., Cyclic dermorphin tetrapeptide analogues obtained via ring-closing metathesis. Acta Biochim Pol. 2006;53(1):73-6. Epub Feb. 23, 2006.

Bernal, et al. (2010). A stapled p53 helix overcomes HDMX-mediated suppression of p53. Cancer Cell 18, 411-422.

Bernal et al., Reactivation of the p53 tumor suppressor pathway by a stapled p53 peptide. (2007) J. Am Chem Soc. 9129, 2456-2457.

Bertrand, et al. (1998). Localization of ASH1 mRNA particles in living yeast. Mol Cell 2, 437-445.

Biagini et al., Cross-metathesis of Unsaturated a-amino Acid Derivatives. J Chem Soc Perkin Trans. 1998;1:2485-99.

Bierzynski et al. A salt bridge stabilizes the helix formed by isolated C-Peptide of RNase A. PNAS USA. 1982;79:2470-2474.

Blackwell, et al. Highly Efficient Synthesis of Covalently Cross-Linked Peptide Helices by Ring-Closing Metathesis. Angewandte Chemie International Edition. 1998; 37(23):3281-3284.

Blackwell, et al. Ring-closing metathesis of olefinic peptides: design, synthesis, and structural characterization of macrocyclic helical peptides. J Org Chem. Aug. 10, 2001;66(16):5291-302.

Blangetti et al., Suzuki-miyaura cross-coupling in acylation reactions, scope and recent developments.Molecules. Jan. 17, 2013;18(1):1188-213. doi:10.3390/molecules18011188.

(56) References Cited

OTHER PUBLICATIONS

Blundell et al., Atomic positions in rhombohedral 2-zinc insulin crystals. Nature. Jun. 25, 1971;231(5304):506-11.
Bo, M.D., et al. (2010). MDM4 (MDMX) is overexpressed in chronic lymphocytic leukaemia (CLL) and marks a subset of p53wild-type CLL with a poor cytotoxic response to Nutlin-3. Br J Haematol 150, 237-239.
Bock, et al. 1,2,3-Triazoles as peptide bond isosteres: synthesis and biological evaluation of cyclotetrapeptide mimics. Org Biomol Chem. Mar. 21, 2007;5(6):971-5.
Bode et al., Chemoselective amide ligations by decarboxylative condensations of N-alkylhydroxylamines and alpha-ketoacids. Angew Chem Int Ed Engl. Feb. 13, 2006;45(8):1248-52.
Boguslavsky, et al. Effect of peptide conformation on membrane permeability. J Pept Res. Jun. 2003;61(6):287-97.
Bossy-Wetzel et al. Assays for cytochrome c release from mitochondria during apoptosis. Methods Enzymol. 322:235-242 (2000).
Bossy-Wetzel, et al. Detection of apoptosis by annexin V labeling. Methods Enzymol. 2000;322:15-8.
Bottger, et al. Molecular characterization of the hdm2-p53 interaction. J Mol Biol. Jun. 27, 1997;269(5):744-56.
Boyden et al. High bone density due to a mutation in LDL-receptor-related protein 5. N Engl J Med 346(20):1513-1521 (2002).
Bracken et al. Synthesis and nuclear magnetic resonance structure determination of an alpha-helical, bicyclic, lactam-bridged hexapeptide. JACS. 1994;116:6431-6432.
Bradley et al. Limits of cooperativity in a structurally modular protein: response of the Notch ankyrin domain to analogous alanine substitutions in each repeat. J Mol Biol. 324(2):373-386 (2002).
Brandt et al., Dimeric fragment of the insulin receptor alpha-subunit binds insulin with full holoreceptor affinity. J Biol Chem. Apr. 13, 2001;276(15):12378-84. Epub Jan. 12, 2001.
Bray, Notch signalling: a simple pathway becomes complex. Nat Rev Mol Cell Biol. Sep. 2006;7(9):678-89.
Brou et al., A novel proteolytic cleavage involved in Notch signaling: the role of the disintegrin-metalloprotease TACE. Mol Cell. Feb. 2000;5(2):207-16.
Brown, et al. A spiroligomer α-helix mimic that binds HDM2, penetrates human cells and stabilizes HDM2 in cell culture. PLoS One. 2012;7(10):e45948. doi: 10.1371/journal.pone.0045948. Epub Oct. 18, 2012.
Brown, et al. Stapled peptides with improved potency and specificity that activate p53. ACS Chem Biol. Mar. 15, 2013;8(3):506-12. doi: 10.1021/cb3005148. Epub Dec. 18, 2012.
Brubaker et al., Solution structure of the interacting domains of the Mad-Sin3 complex: implications for recruitment of a chromatin-modifying complex. Cell. Nov. 10, 2000;103(4):655-65.
Brunel, et al. Synthesis of constrained helical peptides by thioether ligation: application to analogs of gp41. Chem Commun (Camb). May 28, 2005;(20):2552-4. Epub Mar. 11, 2005.
Brusselle et al., Allergen-induced airway inflammation and bronchial responsiveness in wild-type and interleukin-4-deficient mice. Am J Respir Cell Mol Biol. Mar. 1995;12(3):254.-9.
Bueso-Ramos, et al. (1993). The human MDM-2 oncogene is overexpressed in leukemias. Blood 82, 2617-2623.
Burfield & Smithers, Desiccant Efficiency in Solvent Drying. 3. Dipolar Aprotic Solvents, J. Org. Chem. 43(20):3966-3968 (1978).
Burger et aL, Synthesis of a-(trifluoromethyl)-substituted a-amino acids. Part 7. An efficient synthesis for a-trifluoromethyl-substituted w-carboxy a-amino acids. Chemiker-Zeitung. 1990;114(3):101-04. German.
Burgess, et al. (2016). Clinical Overview of MDM2/X-Targeted Therapies. Front Oncol. 2016; 6: 7.
Burrage, et al. Biomimetic synthesis of lantibiotics. Chemistry. Apr. 14, 2000;6(8):1455-66.
Cabezas & Satterthwait, The Hydrogen Bond Mimic Approach: Solid-phase Synthesis of a Peptide Stabilized as an α-Helix with a Hydrazone Link, J. Am. Chem. Soc. 121:3862-3875 (1999).
Campbell, et al. N-alkylated oligoamide alpha-helical proteomimetics. Org Biomol Chem. May 21, 2010;8(10):2344-51. doi: 10.1039/c001164a. Epub Mar. 18, 2010.
Cantel, et al. Synthesis and Conformational Analysis of a Cyclic Peptide Obtained via i to i+4 Intramolecular Side-Chain to Side-Chain Azide-Alkyne 1,3-Dipolar Cycloaddition. JOC Featured Article. Published on the web May 20, 2008.
Caricasole et al., The Wnt pathway, cell-cycle activation and beta-amyloid: novel therapeutic strategies in Alzheimer's disease? Trends Pharmacol Sci. May 2003;24(5):233-8.
Cariello, et al. Resolution of a missense mutant in human genomic DNA by denaturing gradient gel electrophoresis and direct sequencing using in vitro DNA amplification: HPRT Munich. Am J Hum Genet. May 1988;42(5):726-34.
Carillo et al., The Multiple Sequence Alignment Problem in Biology. SIAM J Applied Math. 1988;48:1073-82.
Carlson et al., Specificity landscapes of DNA binding molecules elucidate biological function. Proc Natl Acad Sci USA. Mar. 9, 2010;107(10):4544-9. doi: 10.1073/pnas.0914023107. Epub Feb. 22, 2010.
Carvajal, et al. (2012). E2F7, a novel target, is up-regulated by p53 and mediates DNA damage-dependent transcriptional repression. Genes Dev 26, 1533-1545.
CAS Registry No. 2176-37-6, STN Entry Date Nov. 16, 1984.
CAS Registry No. 2408-85-7, STN Entry Date Nov. 16, 1984.
CAS Registry No. 4727-05-3, STN Entry Date Nov. 16, 1984.
CAS Registry No. 561321-72-0, STN Entry Date Aug. 6, 2003.
CAS Registry No. 721918-14-5, STN Entry Date Aug. 4, 2004.
Chakrabartty et al., Helix Capping Propensities in Peptides Parallel Those in Proteins, Proc. Nat'l Acad. Sci. USA 90:11332-11336 (1993).
Chakrabartty et al., Helix Propensities of the Amino Acids Measured in Alanine-based Peptides without Helix-stabilizing Side-chain Interactions, Protein Sci. 3:843-852 (1994).
Chang, et al. Stapled α-helical peptide drug development: a potent dual inhibitor of MDM2 and MDMX for p53-dependent cancer therapy. Proc Natl Acad Sci U S A. Sep. 3, 2013;110(36):E3445-54. doi: 10.1073/pnas.1303002110. Epub Aug. 14, 2013.
Chapman et al., A Highly Stable Short α-Helix Constrained by a Main-chain Hydrogen-bond Surrogate, J. Am. Chem. Soc. 126:12252-12253 (2004).
Chapman, et al. Optimized synthesis of hydrogen-bond surrogate helices: surprising effects of microwave heating on the activity of Grubbs catalysts. Org Lett. Dec. 7, 2006;8(25):5825-8.
Chapman, et al. Trapping a folding intermediate of the alpha-helix: stabilization of the pi-helix. Biochemistry. Apr. 8, 2008;47(14):4189-95. doi: 10.1021/bi800136m. Epub Mar. 13, 2008.
Chen et al., Determination of the helix and beta form of proteins in aqueous solution by circular dichroism. Biochemistry. Jul. 30, 1974;13(16):3350-9.
Chen, et al. Determination of the Secondary Structures of Proteins by Circular Dichroism and Optical Rotatory Dispersion. Biochemistry. 1972; 11(22):4120-4131.
Chen et al., Small molecule-mediated disruption of Wnt-dependent signaling in tissue regeneration and cancer. Nat Chem Biol. Feb. 2009;5(2):100-7. Epub Jan. 4, 2009.
Chen et al., Structure of the DNA-binding Domains from NFAT, Fos and Jun Bound Specifically to DNA, Nature 392:42-48 (1998).
Cheng et al., Emerging role of RAB GTPases in cancer and human disease. Cancer Res. Apr. 1, 2005;65(7):2516-9.
Cheng et al., The RAB25 small GTPase determines aggressiveness of ovarian and breast cancers. Nat Med. Nov. 2004;10(11):1251-6. Epub Oct. 24, 2004.
Cheon et al., beta-Catenin stabilization dysregulates mesenchymal cell proliferation, motility, and invasiveness and causes aggressive fibromatosis and hyperplastic cutaneous wounds. Proc Natl Acad Sci U S A. May 14, 2002;99(10):6973-8. Epub Apr. 30, 2002.
Chia et al., Emerging roles for Rab family GTPases in human cancer. Biochim Biophys Acta. Apr. 2009;1795(2):110-6.
Chiaramonte et al., Studies of murine schistosomiasis reveal interleukin-13 blockade as a treatment for established and progressive liver fibrosis. Hepatology. Aug. 2001;34(2):273-82.

(56) References Cited

OTHER PUBLICATIONS

Chin & Schepartz, Design and Evolution of a Miniature Bcl-2 Binding Protein, Angew. Chem. Int. Ed. 40(20):3806-3809 (2001).
Chin et al., Circular Dichroism Spectra of Short, Fixed-nucleus Alanine Helices, Proc. Nat'l Acad. Sci. USA 99(24):15416-15421 (2002).
Chittenden, et al. A conserved domain in Bak, distinct from BH1 and BH2, mediates cell death and protein binding functions. EMBO J. Nov. 15, 1995;14(22):5589-96.
Chène et al., Study of the Cytotoxic Effect of a Peptidic Inhibitor of the p53-hdm2 Interaction in Tumor Cells, FEBS Lett. 529:293-297 (2002).
Chène, P., Inhibiting the p53-MDM2 Interaction: An Important Target for Cancer Therapy, Nat Rev. Cancer 3:102-109 (2003).
Cho, et al. An efficient method for removal of ruthenium byproducts from olefin metathesis reactions. Org Lett. Feb. 20, 2003;5(4):531-3.
Choi, et al. Application of azide-alkyne cycloaddition 'click chemistry' for the synthesis of Grb2 SH2 domain-binding macrocycles. Bioorg Med Chem Lett. Oct. 15, 2006;16(20):5265-9.
Christodoulides et al., WNT10B mutations in human obesity. Diabetologia. Apr. 2006;49(4):678-84. Epub Feb. 14, 2006.
Chu, et al. Peptide-formation on cysteine-containing peptide scaffolds. Orig Life Evol Biosph. Oct. 1999;29(5):441-9.
Clark et al., Supramolecular Design by Covalent Capture. Design of a Peptide Cylinder via Hydrogen-Bond-Promoted Intermolecular Olefin Metathesis. J Am Chem Soc. 1995;117:12364-65.
Clavier, et al. Ring-closing metathesis in biphasic BMI.PF6 ionic liquid/toluene medium: a powerful recyclable and environmentally friendly process. Chem Commun (Camb). Oct. 21, 2004;(20):2282-3. Epub Aug. 25, 2004.
Cleary, et al. Nucleotide sequence of a t(14;18) chromosomal breakpoint in follicular lymphoma and demonstration of a breakpoint-cluster region near a transcriptionally active locus on chromosome 18. Proc Natl Acad Sci U S A. Nov. 1985;82(21):7439-43.
Clevers, Wnt/beta-catenin signaling in development and disease. Cell. Nov. 3, 2006;127(3):469-80.
Cline, et al. Effects of As(III) binding on alpha-helical structure. J Am Chem Soc. Mar. 12, 2003;125(10):2923-9.
Cohn et al., Cutting Edge: IL-4-independent induction of airway hyperresponsiveness by Th2, but not Th1, cells. J Immunol. Oct. 15, 1998;161(8):3813-6.
Colaluca et al., NUMB controls p53 tumour suppressor activity. Nature. Jan. 3, 2008;451(7174):76-80. doi: 10.1038/nature06412.
Cole et al., Transcription-independent functions of MYC: regulation of translation and DNA replication. Nat Rev Mol Cell Biol. Oct. 2008;9(10):810-5. Epub Aug. 13, 2008.
Cong et al., A protein knockdown strategy to study the function of beta-catenin in tumorigenesis. BMC Mol Biol. Sep. 29, 2003;4:10.
Conrad, et al. Ruthenium-Catalyzed Ring-Closing Metathesis: Recent Advances, Limitations and Opportunities. Current Organic Chemistry. Jan. 2006; vol. 10, No. 2, 10(2):185-202(18).
Cory et al., The Bcl-2 Family: Roles in Cell Survival and Oncogenesis, Oncogene 22:8590-8607 (2003).
Cossu et al., Wnt signaling and the activation of myogenesis in mammals EMBO J. Dec. 15, 1999;18(24):6867-72.
Cotton et al. Reactivity of cytosine and thymine in single-base-pair mismatches with hydroxylamine and osmium tetroxide and its application to the study of mutations. PNAS USA 85(12):4397-401 (1988).
Cox et al., Insulin receptor expression by human prostate cancers. Prostate. Jan. 1, 2009;69(1):33-40. doi: 10.1002/pros.20852.
Cummings, et al. Disrupting protein-protein interactions with non-peptidic, small molecule alpha-helix mimetics. Curr Opin Chem Biol. Jun. 2010;14(3):341-6. doi: 10.1016/j.cbpa.2010.04.001. Epub Apr. 27, 2010.
Cusack et al. 2,4,6-Tri-isopropylbenzenesulphonyl Hydrazide: A convenient source of Di-Imide. Tetrahedron. 1976;32:2157-2162.
Danial, et al. Cell death: critical control points. Cell. 2004; 116:205-219.

Danial et al., Dual role of proapoptotic BAD in insulin secretion and beta cell survival. Nat Med. Feb. 2008;14(2):144-53. doi: 10.1038/nm1717. Epub Jan. 27, 2008.
Darnell, Transcription factors as targets for cancer therapy. Nat Rev Cancer. Oct. 2002;2(10):740-9.
Daugherty & Gellman, A Fluorescence Assay for Leucine Zipper Dimerization: Avoiding Unintended Consequences of Fluorophore Attachment, J. Am. Chem. Soc. 121:4325-4333 (1999).
David et al., Expressed protein ligation. Method and applications. Eur J Biochem. Feb. 2004;271(4):663-77.
Dawson et al., Synthesis of proteins by native chemical ligation. Science. Nov. 4, 1994;266(5186):776-9.
De Guzman et al., Structural basis for cooperative transcription factor binding to the CBP coactivator. J Mol Biol. Feb. 3, 2006;355(5):1005-13. Epub Oct. 5, 2005.
De La O et al., Notch and Kras reprogram pancreatic acinar cells to ductal intraepithelial neoplasia. Proc Natl Acad Sci U S A. Dec. 2, 2008;105(48)18907-12. doi: 10.1073/pnas.0810111105. Epub Nov. 21, 2008.
De Meyts et al., Insulin interactions with its receptors: experimental evidence for negative cooperativity. Biochem Biophys Res Commun. Nov. 1, 1973;55(1):154-61.
De Meyts, The structural basis of insulin and insulin-like growth factor-I receptor binding and negative co-operativity, and its relevance to mitogenic versus metabolic signalling. Diabetologia. Sep. 1994;37 Suppl 2:S135-48.
De Strooper et al., A presenilin-I-dependent gamma-secretase-like protease mediates release of Notch intracellular domain. Nature. Apr. 8, 1999;398(6727):518-22.
Debinski et al., Retargeting interleukin 13 for radioimmunodetection and radioimmunotherapy of human high-grade gliomas. Clin Cancer Res. Oct. 1999;5(10 Suppl):3143s-3147s.
Definition of Analog from http://cancerweb.ncl.ac.uk/cgi-bin/omd?query=analog. pp. 1-5. Accessed Jul. 7, 2005.
Degterev et al. Identification of Small-molecule Inhibitors of Interaction between the BH3 Domain and Bcl-xL. Nature Cell Biol. 3:173-182 (2001).
Deiters, et al. Adding amino acids with novel reactivity to the genetic code of *Saccharomyces cerevisiae*. J Am Chem Soc. Oct. 1, 2003;125(39):11782-3.
Del Bianco et al., Mutational and energetic studies of Notch 1 transcription complexes. J Mol Biol. Feb. 8, 2008;376(1):131-40. Epub Nov. 28, 2007.
Deng, et al. Cross-Coupling Reaction of Iodo-1,2,3-triazoles Catalyzed by Palladium. Synthesis 2005(16): 2730-2738.
Denmark et al., Cyclopropanation with Diazomethane and Bis(oxazoline)palladium(II) Complexes. J Org Chem. May 16, 1997;62(10):3375-3389.
Dennis et al. Albumin binding as a general strategy for improving the pharmacokinetics of proteins. J Biol Chem. 277(38):35035-35043 (2002).
Designing Custom Peptide. SIGMA Genosys (pp. 1-2) (Accessed Dec. 16, 2004).
Devereux et al., A comprehensive set of sequence analysis programs for the VAX. Nucleic Acids Res. Jan. 11, 1984;12(1 Pt 1):387-95.
Dimartino et al, A General Approach for the Stabilization of Peptide Secondary Structures, American Chemical Society Meeting, New York (Sep. 2003) (poster).
Dimartino et al. Solid-phase synthesis of hydrogen-bond surrogate-derived alpha-helices. Org Lett. Jun. 9, 2005;7(12):2389-92.
Dombroski et al., Isolation of an active human transposable element. Science. Dec. 20, 1991;254(5039):1805-8.
Doron, et al. Probiotics: their role in the treatment and prevention of disease. Expert Rev Anti Infect Ther. Apr. 2006;4(2):261-75.
Dovey et al., Functional gamma-secretase inhibitors reduce beta-amyloid peptide levels in brain. J Neurochem. Jan. 2001;76(1):173-81.
Duronio, Insulin receptor is phosphorylated in response to treatment of HepG2 cells with insulin-like growth factor I. Biochem J. Aug. 15, 1990;270(1):27-32.
Dyson, et al. Applications of ionic liquids in synthesis and catalysis. Interface-Electrochemical Society. 2007; 16(1), 50-53.

(56) References Cited

OTHER PUBLICATIONS

Eckert & Kim, Mechanisms of Viral Membrane Fusion and Its Inhibition, Annu. Rev. Biochem. 70:777-810 (2001).
Eglen et al., The use of AlphaScreen technology in HTS: current status. Curr Chem Genomics. Feb. 25, 2008;1:2-10. doi: 10.2174/1875397300801010002.
Eisenmesser et al., Solution structure of interleukin-13 and insights into receptor engagement. J Mol Biol. Jun. 29, 2001;310(1):231-41.
Ellis et al., Design, synthesis, and evaluation of a new generation of modular nucleophilic glycine equivalents for the efficient synthesis of sterically constrained alpha-amino acids. J Org Chem. Oct. 27, 2006;71(22):8572-8.
Ellisen et al., TAN-1, the human homolog of the *Drosophila* notch gene, is broken by chromosomal translocations in T lymphoblastic neoplasms. Cell. Aug. 23, 1991;66(4):649-61.
Ellman. Tissue sulfhydryl groups. Arch Biochem Biophys. May 1959;82(1):70-7.
Erlanson, et al. Facile synthesis of cyclic peptides containing di-, tri-, tetra-, and Pentasulfides. Tetrahedron Letters. 1998; 39(38):6799-6802.
Erlanson et al., The leucine zipper domain controls the orientation of AP-1 in the NFAT.AP-1.DNA complex. Chem Biol. Dec. 1996;3(12):981-91.
European Medicines Agency, Guideline on the specification limits for residues of metal catalysts or metal regents. Feb. 2008; pp. 1-34.
European Medicines Agency (Pre-authorization Evaluation of Medicines for Human Use, London, Jan. 2007, p. 1-32).
European office action dated Aug. 20, 2012 for EP Application No. 09730445.5.
European search opinion dated Nov. 19, 2014 for EP 09828398.9.
European search report and search opinion dated Mar. 22, 2017 for EP Application No. 16190185.5.
Evans et al., The Rise of Azide—Alkyne 1,3-Dipolar 'Click' Cycloaddition and its Application to Polymer Science and Surface Modification. Australian Journal of Chemistry. 2007;60:384-95.
Extended European Search Report for EP 09800675.2, dated Dec. 6, 2012.
Extended European Search Report for EP 10800148.8, dated Oct. 16, 2013.
Extended European Search Report for EP 12159110.1, dated Jul. 20, 2012.
Extended European Search Report for EP 12800679.8, dated Oct. 2, 2014.
Extended European Search Report (Replacement Copy) for EP 12159110 1, dated Sep. 27, 2012.
Faderl, et al. (2000). The prognostic significance of p16(INK4a)/p14(ARF) locus deletion and MDM-2 protein expression in adult acute myelogenous leukemia. Cancer 89, 1976-1982.
Favrin et al., Two-state folding over a weak free-energy barrier. Biophys J. Sep. 2003;85(3):1457-65.
Felix et al., Synthesis, Biological Activity and Conformational Analysis of Cyclic GRF Analogs, Int. J. Pep. Protein Res. 32:441-454 (1988).
Feng et al. Solid-phase SN2 macrocyclization reactions to form beta-turn mimics. Org Lett. Jul. 15, 1999;1(1):121-4.
Fields, et al. Chapter 3 in Synthetic Peptides: A User's Guide. Grant W.H. Freeman & Co. New York, NY. 1992. p. 77.
Fieser, et al. Fieser and Fieser's Reagents for Organic Synthesis. John Wiley and Sons. 1994.
File Hcaplus on STN. AN No. 1986:572318. Armstrong et al. X=Y-ZH systems as potential 1,3-dipoles. 5. Intramolecular imines of α-amino acid esthers. Tetrahedron. 1985; 41(17):3547-58. Abstract only. Abstract date Nov. 1986.
File Hcaplus on STN. AN No. 1990:532752. Burger et al. Synthesis of a-(trifluoromethyl)-substituted a-amino acids. Part 7. An efficient synthesis for a-trifluoromethyl-substituted w-carboxy a-amino acids. Chemiker-Zeitung (1990), 114(3), 101-4. Abstract only, date Oct. 1990.
File Hcaplus on STN. AN No. 1979:168009. Greenlee et al. A general synthesis of alpha-vinyl-alpha-amino acids Tetrahedron Letters (1978), (42), 3999-4002. Abstract date 1984.
Fischbach et al., Specific biochemical inactivation of oncogenic Ras proteins by nucleoside diphosphate kinase. Cancer Res. Jul. 15, 2003;63(14):4089-94.
Fischer, et al. Apoptosis-based therapies and drug targets. Cell Death and Differentiation. 2005; 12:942-961.
Fischer et al., The HIV-1 Rev activation domain is a nuclear export signal that accesses an export pathway used by specific cellular RNAs. Cell. Aug. 11, 1995;82(3):475-83.
Fisher et al., Myc/Max and other helix-loop-helix/leucine zipper proteins bend DNA toward the minor groove. Proc Natl Acad Sci U S A. Dec. 15, 1992;89(24):11779-83.
Formaggio et al., Inversion of 3(10)-helix screw sense in a (D-alpha Me)Leu homo-tetrapeptide induced by a guest D-(alpha Me)Val residue. J Pept Sci. Nov.-Dec. 1995;1(6):396-402.
Friedman-Einat, et al. Target gene identification: target specific transcriptional activation by three murine homeodomain/VP16 hybrid proteins in *Saccharomyces cerevisiae*. J Exp Zool. Feb. 15, 1996;274(3):145-56.
Friedmann et al., RAM-induced allostery facilitates assembly of a notch pathway active transcription complex. J Biol Chem. May 23, 2008;283(21):14781-91. doi: 10.1074/jbc.M709501200. Epub Apr. 1, 2008.
Fromme et al., Structural basis for removal of adenine mispaired with 8-oxoguanine by MutY adenine DNA glycosylase. Nature. Feb. 12, 2004;427(6975):652-6.
Fryer et al., Mastermind mediates chromatin-specific transcription and turnover of the Notch enhancer complex. Genes Dev. Jun. 1, 2002;16(11):1397-411.
Fuchs et al., Socializing with the neighbors: stem cells and their niche. Cell. Mar. 19, 2004;116(6):769-78.
Fulda, et al. Extrinsic versus intrinsic apoptosis pathways in anti-cancer chemotherapy. Oncogene. Aug. 7, 2006;25(34):4798-811.
Fung et al., Delta-like 4 induces notch signaling in macrophages: implications for inflammation. Circulation. Jun. 12, 2007;115(23):2948-56. Epub May 28, 2007.
Furstner et al., Alkyne Metathesis: Development of a Novel Molybdenum-Based Catalyst System and Its Application to the Total Synthesis of Epothilone A and C. Chem Euro J. 2001 ;7(24):5299-5317.
Furstner, et al. Mo[N(t-Bu)(AR)]3 Complexes as catalyst precursors: in situ activation and application to metathesis reactions of alkynes and diynes. J Am chem Soc. 1999; 121:9453-54.
Furstner, et al. Nozaki—Hiyama—Kishi reactions catalytic in chromium. J Am Chem Soc. 1996; 118:12349-57.
Fustero, et al. Asymmetric synthesis of new beta,beta-difluorinated cyclic quaternary alpha-amino acid derivatives. Org Lett. Aug. 31, 2006;8(18):4129-32.
Galande, et al. Thioether side chain cyclization for helical peptide formation: inhibitors of estrogen receptor-coactivator interactions. Journal of Peptide Research. 2004; 63(3): 297-302.
Galande, et al. An effective method of on-resin disulfide bond formation in peptides. J Comb Chem. Mar.-Apr. 2005;7(2):174-7.
Gallivan et al., A neutral, water-soluble olefin metathesis catalyst based on an N-heterocyclic carbene ligand. Tetrahedron Letters. 2005;46:2577-80.
Gallou, et al. A practical method for the removal of ruthenium byproducts by supercritical fluid extraction. Organic Process Research and Development. 2006; 10:937-940.
Galluzzi, et al. Guidelines for the use and interpretation of assays for monitoring cell death in higher eukaryotes. Cell Death Differ. Aug. 2009;16(8):1093-107. Epub Apr. 17, 2009.
Gante, Peptidomimetics—Tailored Enzyme Inhibitors. J Angew Chem Int Ed Engl. 1994;33:1699-1720.
García-Echeverría et al., Discovery of Potent Antagonists of the Interaction between Human Double Minute 2 and Tumor Suppressor p53, J. Med. Chem. 43:3205-3208 (2000).
Garg et al., Mutations in NOTCH1 cause aortic valve disease. Nature. Sep. 8, 2005;437(7056):270-4. Epub Jul. 17, 2005.

(56) References Cited

OTHER PUBLICATIONS

Gat et al., De Novo hair follicle morphogenesis and hair tumors in mice expressing a truncated beta-catenin in skin. Cell. Nov. 25, 1998;95(5):605-14.

Gavathiotis et al., BAX activation is initiated at a novel interaction site. Nature. Oct. 23, 2008;455(7216):1076-81.

Geistlinger & Guy, An Inhibitor of the Interaction of Thyroid Hormone Receptor β and Glucocorticoid Interacting Protein 1, J. Am. Chem. Soc. 123:1525-1526 (2001).

Gemperli et al., Paralog-selective Ligands for Bcl-2 Proteins, J. Am. Chem. Soc. 127:1596-1597 (2005).

Gentle et al., Direct production of proteins with N-terminal cysteine for site-specific conjugation. Bioconjug Chem. May-Jun. 2004;15(3):658-63.

Gerber-Lemaire et al., Glycosylation pathways as drug targets for cancer: glycosidase inhibitors. Mini Rev Med Chem. Sep. 2006;6(9):1043-52.

Ghadiri & Choi, Secondary Structure Nucleation in Peptides. Transition Metal Ion Stabilized α-Helices, J. Am. Chem. Soc. 112:1630-1632 (1990).

Giannis et aL, Peptidomimetics for Receptor Ligands—Discovery, Development, and Medical Perspectives. Angew Chem Int Ed Engl. 1993;32:1244-67.

Glover & Harrison, Crystal Structure of the Heterodimeric bZIP Transcription Factor c-Fos-c-Jun Bound to DNA, Nature 373:257-261 (1995).

Goncalves, et al. On-resin cyclization of peptide ligands of the Vascular Endothelial Growth Factor Receptor 1 by copper(I)-catalyzed 1,3-dipolar azide-alkyne cycloaddition. Bioorg Med Chem Lett. Oct. 15, 2007;17(20):5590-4.

Gong et al. LDL receptor-related protein 5 (LRP5) affects bone accrual and eye development. Cell 107:513-523 (Nov. 16, 2001).

Goodson et al., Potential Growth Antagonists. I. Hydantoins and Disubstituted Glycines. J Org Chem. 1960;25:1920-24.

Gorlich et al., Transport between the cell nucleus and the cytoplasm. Annu Rev Cell Dev Biol. 1999;15:607-60.

Goun et al., Molecular transporters: synthesis of oligoguanidinium transporters and their application to drug delivery and real-time imaging. Chembiochem. Oct. 2006;7(10):1497-515.

Gras-Masse, et al. Influence of helical organization on immunogenicity and antigenicity of synthetic peptides. Mol Immunol. Jul. 1988;25(7):673-8.

Greene, et al. Protective Groups in Organic Synthesis, 2nd Ed. John Wiley and Sons. 1991.

Greenfield et al. Computed circular dichroism spectra for the evaluation of protein conformation. Biochemistry. Oct. 8, 1969;(10):4108-4116.

Greenlee et al., A General Synthesis of a-vinyl-a-amino acids. Tetrahedron Letters. 1978;42:3999-40002.

Grossman, et al. Inhibition of oncogenic Wnt signaling through direct targeting of -catenin. Proc. Natl. Acad. Sco. 2012; 109(44)17942-179747.

Grunig et al., Requirement for IL-13 independently of IL-4 in experimental asthma. Science. Dec. 18, 1998;282(5397):2261-3.

Gu, et al. (2002). Mutual dependence of MDM2 and MDMX in their functional inactivation of p53. J Biol Chem 277, 19251-19254.

Guinn et al., Synthesis and characterization of polyamides containing unnatural amino acids. Biopolymers. May 1995;35(5):503-12.

Guo et al., Probing the alpha-helical structural stability of stapled p53 peptides: molecular dynamics simulations and analysis. Chem Biol Drug Des. Apr. 2010;75(4):348-59. doi: 10.1111/j.1747-0285.2010.00951.x.

Gupta et al., Long-term effects of tumor necrosis factor-alpha treatment on insulin signaling GUPTA pathway in HepG2 cells and HepG2 cells overexpressing constitutively active Akt/PKB. J Cell Biochem. Feb. 15, 2007;100(3):593-607.

Hamard, et al (2012). P53 basic C terminus regulates p53 functions through DNA binding modulation of subset of target genes. J Biol Chem 287, 22397-22407.

Hanessian, et al. Structure-based design and synthesis of macroheterocyclic peptidomimetic inhibitors of the aspartic protease beta-site amyloid precursor protein cleaving enzyme (BACE). J Med Chem. Jul. 27, 2006;49(15):4544-67.

Hara, S. et al. 'Synthetic studies on halopeptins, anti-inflammatory cyclodepsipeptides', Peptide Science. 2006 (vol. date 2005), 42nd, pp. 39-42.

Harper et al., Efficacy of a bivalent L1 virus-like particle vaccine in prevention of infection with human papillomavirus types 16 and 18 in young women: a randomized controlled trial. Lancet. Nov. 13-19, 2004;364(9447):1757-65.

Harris et al., Synthesis of proline-modified analogues of the neuroprotective agent glycyl-l-prolyl-glutamic acid (GPE). Tetrahedron. 2005;61:10018-35.

Harrison, et al. Downsizing human, bacterial, and viral proteins to short water-stable alpha helices that maintain biological potency. Proc Natl Acad Sci U S A. Jun. 29, 2010;107(26):11686-91. doi: 10.1073/pnas.1002498107. Epub Jun. 11, 2010.

Hartmann, A Wnt canon orchestrating osteoblastogenesis. Trends Cell Biol. Mar. 2006;16(3):151-8. Epub Feb. 7, 2006.

Hartmann et al., Dual roles of Wnt signaling during chondrogenesis in the chicken limb. Development. Jul. 2000;127(14):3141-59.

Hase; et al., 1,6-Aminosuberic acid analogs of lysine- and arginine-vasopressin and -vasotocin. Synthesis and biological properties. J Am Chem Soc. May 17, 1972;94(10):3590-600.

Haupt, et al. (1997). Mdm2 promotes the rapid degradation of p53. Nature 387, 296-299.

Hein, et al. Copper(I)-Catalyzed Cycloaddition of Organic Azides and 1-Iodoalkynes. Angew Chem Int Ed Engl. 2009;48(43):8018-21.

Hellman et al., Electrophoretic mobility shift assay (EMSA) for detecting protein-nucleic acid interactions. Nat Protoc. 2007;2(8):1849-61.

Henchey et al., Contemporary strategies for the stabilization of peptides in the a-helical conformation. Curr Opin Chem Biol. 2008;12:692-97.

Henchey, et al. High specificity in protein recognition by hydrogen-bond-surrogate α-helices: selective inhibition of the p53/MDM2 complex. Chembiochem. Oct. 18, 2010;11(15):2104-7. doi: 10.1002/cbic.201000378.

Henchey, et al. Inhibition of Hypoxia Inducible Factor 1-Transcription Coactivator Interaction by a Hydrogen Bond Surrogate α-Helix. J Am Chem Soc. Jan. 27, 2010;132(3):941-3.

Hilton et al., Notch signaling maintains bone marrow mesenchymal progenitors by suppressing osteoblast differentiation. Nat Med. Mar. 2008;14(3):306-14. doi: 10.1038/nm1716. Epub Feb. 24, 2008.

Hipfner et al., Connecting proliferation and apoptosis in development and disease. Nat Rev Mol Cell Biol. Oct. 2004;5(10):805-15.

Hiroshige, et al. Palladium-mediated macrocyclisations on solid support and its applica-tions to combinatorial synthesis. J. Am. Chem. Soc. 1995; 117:11590-11591.

Hoang et al., Dickkopf 3 inhibits invasion and motility of Saos-2 osteosarcoma cells by modulating the Wnt-beta-catenin pathway. Cancer Res. Apr. 15, 2004;64(8):2734-9.

Holford et al., Adding 'splice' to protein engineering. Structure. Aug. 15, 1998;6(8):951-6.

Honda, et al. Oncoprotein MDM2 is a ubiquitin ligase E3 for tumor suppressor p53. FEBS Lett. 1997 Dec. 22, 1997;420(1):25-7.

Hong, et al. Efficient removal of ruthenium byproducts from olefin metathesis products by simple aqueous extraction. Org Lett. May 10, 2007;9(10):1955-7.

Horiguchi, et al. Identification and characterization of the ER/lipid droplet-targeting sequence in 17beta-hydroxysteroid dehydrogenase type 11. Arch Biochem Biophys. Nov. 15, 2008;479(2):121-30. doi: 10.1016/j.abb.2008.08.020. Epub Sep. 10, 2008.

Horne, et al. Foldamers with heterogeneous backbones. Acc Chem Res. Oct. 2008;41(10):1399-408. doi: 10.1021/ar800009n. Epub Jul. 1, 2008.

Horne, et al. Heterocyclic peptide backbone modifications in an alpha-helical coiled coil. J Am Chem Soc. Dec. 1, 2004;126(47):15366-7.

(56) References Cited

OTHER PUBLICATIONS

Horne, et al. Structural and biological mimicry of protein surface recognition by alpha/beta-peptide foldamers. Proc Natl Acad Sci U S A. Sep. 1, 2009;106(35):14751-6. doi: 10.1073/pnas.0902663106. Epub Aug. 17, 2009.

Hoveyda et al., Ru Complexes Bearing Bidentate Carbenes: From Innocent Curiosity to Uniquely Effective Catalysts for Olefin Metathesis, Org. Biomolec. Chem. 2:8-23 (2004).

Hu, et al. Efficient p53 activation and apoptosis by simultaneous disruption of binding to MDM2 and MDMX. Cancer Res. Sep. 15, 2007;67(18):8810-7.

Huang et al., How insulin binds: the B-chain alpha-helix contacts the LI beta-helix of the insulin receptor. J Mol Biol. Aug. 6, 2004;341(2):529-50.

Huang et al., Tankyrase inhibition stabilizes axin and antagonizes Wnt signalling. Nature. Oct. 1, 2009;461(7264):614-20. Epub Sep. 16, 2009.

Hunt, S. The Non-Protein Amino Acids. In: Barrett G.C., ed. Chemistry and Biochemistry of the Amino Acids. New York; Chapman and Hall; 1985.

International Preliminary Report on Patentability dated Apr. 14, 2016 for PCT/US2014/058680.

International Preliminary Report on Patentability dated Dec. 17, 2015 for PCT/US2014/41338.

International Preliminary Report on Patentability dated Dec. 23, 2015 for PCT/US2014/042329.

International Preliminary Report on Patentability for PCT/US2008/058575 dated Oct. 8, 2009.

International Preliminary Report on Patentability for PCT/US2009/004260 dated Feb. 3, 2011.

International Preliminary Report on Patentability for PCT/US2010/001952 dated Jan. 26, 2012.

International Preliminary Report on Patentability for PCT/US2011/052755, dated Apr. 4 2013.

International Preliminary Report on Patentability for PCT/US2012/042719, dated Jan. 3, 2014.

International Preliminary Report on Patentability for PCT/US2012/042738, dated Jan. 3, 2014.

International Preliminary Report on Patentability for PCT/US2013/062004, dated Apr. 9, 2015.

International Preliminary Report on Patentability for PCT/US2013/062929, dated Apr. 16, 2015.

International Preliminary Report on Patentability for PCT/US2014/025544, dated Sep. 24, 2015.

International search report and written opinion dated Mar. 3, 2014 for PCT/US2013/068147.

International search report and written opinion dated May 23, 2013 for PCT/US2013/026241.

International search report and written opinion dated May 29, 2013 for PCT/US2013/026238.

International search report and written opinion dated Oct. 12, 2011 for PCT/US2011/047692.

International Search Report and Written Opinion dated Nov. 10, 2014 for PCT/US2014/41338.

International Search Report and Written Opinion dated Nov. 24, 2014 for PCT/US2014/042329.

International search report and written opinion dated Dec. 6, 2016 for PCT Application No. PCT/US2016/050194.

International Search Report and Written Opinion for PCT/US2008/052580, dated May 16, 2008.

International Search Report and Written Opinion for PCT/US2008/058575 dated Nov. 17, 2008.

International Search Report and Written Opinion for PCT/US2009/004260 dated Oct. 15, 2010.

International Search Report and Written Opinion for PCT/US2010/001952 dated Feb. 2, 2011.

International Search Report and Written Opinion for PCT/US2011/052755 dated Apr. 25, 2012.

International Search Report and Written Opinion for PCT/US2012/042719, dated Nov. 1, 2012.

International Search Report and Written Opinion for PCT/US2012/042738, dated Oct. 18, 2012.

International Search Report and Written Opinion for PCT/US2013/062004, dated Apr. 23, 2014.

International Search Report and Written Opinion for PCT/US2013/062929, dated Jan. 30, 2014.

International Search Report and Written Opinion for PCT/US2014/025544, dated Sep. 10, 2014.

International Search Report and Written Opinion for PCT/US2014/058680, dated Apr. 23, 2015.

International search report dated May 11, 2006 for PCT Application No. US2005/016894.

International search report dated Nov. 30, 2009 for PCT Application No. US2009/02225.

International search report dated Mar. 17, 2010 for PCT Application No. US2009-057931.

International search report dated Apr. 28, 2008 for PCT Application No. US2007/87615.

International search report dated May 18, 2005 for PCT Application No. US2004/38403.

International Search Report dated Sep. 10, 2014 for PCT Application No. US2014/025544.

International search report dated Sep. 25, 2008 for PCT Application No. US2008/54922.

Invitation to Pay Additional Fees for PCT/US2009/004260 dated Mar. 19, 2010.

Invitation to Pay Additional Fees for PCT/US2010/001952 dated Oct. 29, 2010.

Invitation to Pay Additional Fees for PCT/US2011/052755 dated Feb. 16, 2012.

Invitation to Pay Additional Fees for PCT/US2013/062004, dated Jan. 2, 2014.

Invitation to Pay Aditional Fes for PCT/US2014/025544, dated Jul. 22, 2014.

Ishikawa, et al. (2007). Chemotherapy-resistant human AML stem cells home to and engraft within the bone-marrow endosteal region. Nat Biotechnol 25, 1315-1321.

Isidro-Llobet, et al. Amino acid-protecting groups. Chem Rev. Jun. 2009;109(6):2455-504. doi: 10.1021/cr800323s.

Jackson et al. General approach to the synthesis of short alpha-helical peptides. JACS. 1991;113:9391-9392.

Jamieson et al., Granulocyte-macrophage progenitors as candidate leukemic stem cells in blast-crisis CML. N Engl J Med. Aug. 12, 2004;351(7):657-67.

Jensen et al., Activation of the insulin receptor (IR) by insulin and a synthetic peptide has different effects on gene expression in IR-transfected L6 myoblasts. Biochem J. Jun. 15, 2008;412(3):435-45. doi: 10.1042/BJ20080279.

Ji, et al. In vivo activation of the p53 tumor suppressor pathway by an engineered cyclotide. J Am Chem Soc. Aug. 7, 2013;135(31):11623-33. doi: 10.1021/ja405108p. Epub Jul. 25, 2013.

Jin, et al. Structure-based design, synthesis, and activity of peptide inhibitors of RGS4 GAP activity. Methods Enzymol. 2004;389:266-77.

Jin, et al. Structure-based design, synthesis, and pharmacologic evaluation of peptide RGS4 inhibitors. J Pept Res. Feb. 2004;63(2):141-6.

Joerger, et al. Structural biology of the tumor suppressor p53. Annu Rev Biochem. 2008;77:557-82. doi: 10.1146/annurev.biochem.77.060806.091238.

Johannesson, et al. Vinyl sulfide cyclized analogues of angiotensin II with high affinity and full agonist activity at the AT(1) receptor. J Med Chem. Apr. 25, 2002;45(9):1767-77.

Jones, et al. (1998). Overexpression of Mdm2 in mice reveals a p53-independent role for Mdm2 in tumorigenesis. Proc Natl Acad Sci U S A 95, 15608-15612.

Jordan et al., Wnt4 overexpression disrupts normal testicular vasculature and inhibits testosterone synthesis by repressing steroidogenic factor 1/beta-catenin synergy. Proc Natl Acad Sci U S A. Sep. 16, 2003;100(19):10866-71. Epub Aug. 29, 2003.

Joutel et al., Notch3 mutations in CADASIL, a hereditary adult-onset condition causing stroke and dementia. Nature. Oct. 24, 1996;383(6602):707-10.

(56) References Cited

OTHER PUBLICATIONS

Jung, et al. (2013). TXNIP maintains the hematopoietic cell pool by switching the function of p53 under oxidative stress. Cell Metab 18, 75-85.
Junutula et al., Molecular characterization of RabII interactions with members of the family of RabI I-interacting proteins. J Biol Chem. Aug. 6, 2004;279(32):33430-7. Epub Jun. 1, 2004.
Kallen, et al. Crystal structures of human MdmX(HdmX) in complex with p53 peptide analogues reveal surprising conformational changes. Journal of Biological Chemistry. Mar. 27, 2009; 284:8812-8821.
Kanan et al. Reaction discovery enabled by DNA-templated synthesis and in vitro selection. Nature. Sep. 30, 2004;431(7008):545-9.
Kandoth et al. Mutational landscape and significance across 12 major cancer types. Nature 502(7471):333-339 (2013).
Karle, et al. Structural charateristics of alpha-helical peptide molecules containing Aib residues. Biochemistry. Jul. 24, 1990;29(29):6747-56.
Karle. Flexibility in peptide molecules and restraints imposed by hydrogen bonds, the Aib residue, and core inserts. Biopolymers. 1996;40(1):157-80.
Karwoski et al., Lysinonorleucine cross-link formation in alpha amino heptenoic acid-substituted peptide derivatives. Biopolymers. 1978;17(5):1119-27.
Katoh et al., Cross-talk of WNT and FGF signaling pathways at GSK3beta to regulate beta-catenin and SNAIL signaling cascades. Cancer Biol Ther. Sep. 2006;5(9):1059-64. Epub Sep. 4, 2006.
Katsu et al., The human frizzled-3 (FZD3) gene on chromosome 8p21, a receptor gene for Wnt ligands, is associated with the susceptibility to schizophrenia. Neurosci Lett. Dec. 15, 2003;353(1):53-6.
Kaul & Balaram, Stereochemical Control of Peptide Folding, Bioorg. Med. Chem. 7:105-117 (1999).
Kawamoto, Targeting the BCL9/B9L binding interaction with beta-catenin as a potential anticancer strategy. PhD Thesis. Jun. 3, 2010. Available at http://deepblue.lib.umich.edu/handle/2027.42/75846 last accessed Apr. 9, 2012. Abstract only. 2 pages.
Kazmaier, Sythesis of Quaternary Amino Acids Containing 13, y- as well as 7,6-Unsaturated Side Chains via Chelate-Enolate Claisen Rearrangement. Tetrahedron Letters. 1996;37(30):5351-4.
Kedrowski, B.L. et al. 'Thiazoline ring formation from 2-methylcysteines and 2-halomethylalanines', Heterocycles. 2002, vol. 58, pp. 601-634.
Kelly-Welch et al, Interleukin-4 and Interleukin-13 Signaling Connections Maps. Science. 2003;300:1527-28.
Kelso et al., A Cyclic Metallopeptide Induces α Helicity in Short Peptide Fragments of Thermolysin, Angew. Chem. Int. Ed. 42(4):421-424 (2003).
Kelso et al., α-Turn Mimetics: Short Peptide α-Helices Composed of Cyclic Metallopentapeptide Modules, J. Am. Chem. Soc. 126:4828-4842 (2004).
Kemp et al., Studies of N-Terminal Templates for α-Helix Formation. Synthesis and Conformational Analysis of (2S,5S,8S,11S)-1-Acetyl-1,4-diaza-3-keto-5-carboxy-10-thiatricyclo[2.8.1.04,8]-tridecane (Ac-Hel1-OH), J. Org. Chem. 56:6672-6682 (1991).
Kemp et al., Studies of N-Terminal Templates for α-Helix Formation. Synthesis and Conformational Analysis of Peptide Conjugates of (2S,5S,8S,11S)-1-Acetyl-1,4-diaza-3-keto-5-carboxy-10-thiatricyclo[2.8.1.04,8]-tridecane (AC-Hel1-OH), J. Org. Chem. 56:6683-6697 (1991).
Kent. Advanced Biology. Oxford University Press. 2000.
Khalil et al., An efficient and high yield method for the N-tert-butoxycarbonyl protection of sterically hindered amino acids. Tetrahedron Lett. 1996;37(20):3441-44.
Kilby et al., Potent Suppression of HIV-1 Replication in Humans by T-20, a Peptide Inhibitor of gp41-Mediated Virus Entry, Nat. Med. 4(11):1302-1307 (1998).

Kim et al., Introduction of all-hydrocarbon i,i+3 staples into alpha-helices via ring-closing olefin metathesis. Org Lett. Jul. 2, 2010;12(13):3046-9. doi: 10.1021/011010449.
Kim et al., Stereochemical effects of all-hydrocarbon tethers in i,i+4 stapled peptides. Bioorg Med Chem Lett. May 1, 2009;19(9):2533-6. Epub Mar. 13, 2009.
Kim et al., Synthesis of all-hydrocarbon stapled a-helical peptides by ring-closing olefin metathesis. Nat Protoc. Jun. 2011;6(6):761-71. doi: 10.1038/nprot.2011.324. Epub May 12, 2011.
Kimmerlin et al., '100 years of peptide synthesis': ligation methods for peptide and protein synthesis with applications to beta-peptide assemblies. J Pept Res. Feb. 2005;65(2):229-60.
Kinage, et al. Highly regio-selective synthesis of beta-amino alcohol by reaction with aniline and propylene carbonate in self solvent systems over large pore zeolite catalyst. Green and Sustainable Chem. Aug. 2011;1: 76-84.
Kinzler et al., Identification of FAP locus genes from chromosome 5q21. Science. Aug. 9, 1991;253(5020):661-5.
Kinzler et al., Lessons from hereditary colorectal cancer. Cell. Oct. 18, 1996;87(2):159-70.
Knackmuss et al., Specific inhibition of interleukin-13 activity by a recombinant human single-chain immunoglobulin domain directed against the IL-13 receptor alpha1 chain. Biol Chem. Mar. 2007;388(3):325-30.
Kohler et al., DNA specificity enhanced by sequential binding of protein monomers. Proc Natl Acad Sci U S A. Oct. 12, 1999;96(21):11735-9.
Kolb et al., Click Chemistry: Diverse Chemical Function from a Few Good Reactions. Angew Chem Int Ed Engl. Jun. 1, 2001;40(11):2004-2021.
Kondo et al., Frizzled 4 gene (FZD4) mutations in patients with familial exudative vitreoretinopathy with variable expressivity. Br J Ophthalmol. Oct. 2003;87(10):1291-5.
Konishi et al Gamma-secretase inhibitor prevents Notch3 activation and reduces proliferation in human lung cancers. Cancer Res. Sep. 1, 2007;67(17):8051-7.
Korcsmaros et al., Uniformly curated signaling pathways reveal tissue-specific cross-talks and support drug target discovery. Bioinformatics. Aug. 15, 2010;26(16):2042-50. Epub Jun. 11, 2010.
Korinek et al. Depletion of epithelial stem-cell compartments in the small intestine of mice lacking Tcf-4. Nat Genet 19(4):379-383 (1998).
Kosir, et al. Breast Cancer. Available at https://www.merckmanuals.com/home/women-s-health-issues/breast-disorders/breast-cancer. Accessed on Jun. 29, 2016.
Kotha et al., Modification of constrained peptides by ring-closing metathesis reaction. Bioorg Med Chem Lett. Jun. 4, 2001;11(11):1421-3.
Kouzarides, Acetylation: a regulatory modification to rival phosphorylation? EMBO J. Mar. 15, 2000;19(6):1176-9.
Kovall et al., Crystal structure of the nuclear effector of Notch signaling, CSL, bound to DNA. EMBO J. Sep. 1, 2004;23(17):3441-51. Epub Aug. 5, 2004.
Kozlovsky et aL, GSK-3 and the neurodevelopmental hypothesis of schizophrenia. Eur Neuropsychopharmacol. Feb. 2002;12(1):13-25.
Kristensen et al., Expression and characterization of a 70-kDa fragment of the insulin receptor that binds insulin. Minimizing ligand binding domain of the insulin receptor. J Biol Chem. Jul. 10, 1998;273(28):17780-6.
Kristensen et al., Functional reconstitution of insulin receptor binding site from non-binding receptor fragments. J Biol Chem. May 24, 2002;277(21):18340-5. Epub Mar. 18, 2002.
Kritzer et al., Helical β-Peptide Inhibitors of the p53-hDM2 Interaction, J. Am. Chem. Soc. 126:9468-9469 (2004).
Kubbutat, et al. Regulation of p53 stability by Mdm2. Nature. May 15, 1997;387(6630):299-303.
Kudaj, et al. An efficient synthesis of optically pure alpha-alkyl-beta-azido- and alpha-alkyl-beta-aminoalanines via ring opening of 3-amino-3-alkyl-2-oxetanones. Tetrahedron Letters. 2007; 48:6794-6797.
Kurose et al., Cross-linking of a B25 azidophenylalanine insulin derivative to the carboxyl-terminal region of the alpha-subunit of

(56) References Cited

OTHER PUBLICATIONS the insulin receptor. Identification of a new insulin-binding domain in the insulin receptor. J Biol Chem. Nov. 18, 1994;269(46):29190-7.

Kussie et al, Structure of the MDM2 Oncoprotein Bound to the p53 Tumor Suppressor Transactivation Domain, Science 274:948-953 (1996).

Kutchukian et al., All-atom model for stabilization of alpha-helical structure in peptides by hydrocarbon staples. J Am Chem Soc. Apr. 8, 2009;131(13):4622-7.

Kutzki et al., Development of a Potent Bcl-xL Antagonist Based on α-Helix Mimicry, J. Am. Chem. Soc. 124:11838-11839 (2002).

Kwon, et al. Quantitative comparison of the relative cell permeability of cyclic and linear peptides. Chem Biol. Jun. 2007;14(6):671-7.

Lacombe et al. Reduction of olefins on solid support using diimide. Tetrahedron Letters. 1998;39:6785-6786.

Lammi et al., Mutations in AXIN2 cause familial tooth agenesis and predispose to colorectal cancer. Am J Hum Genet. May 2004;74(5):1043-50. Epub Mar. 23, 2004.

Laporte et al., Molecular and structural basis of cytokine receptor pleiotropy in the interleukin-4/13 system. Cell. Jan. 25, 2008;132(2):259-72.

Larock, R.C. Comprehensive Organic Transformations, New York: VCH Publishers; 1989.

Le Geuzennec et al., Molecular characterization of Sin3 PAH-domain interactor specificity and identification of PAH partners. Nucleic Acids Res. 2006;34(14):3929-37. Epub Aug. 12, 2006.

Le Geuzennec et al., Molecular determinants of the interaction of Mad with the PAH2 domain of mSin3. J Biol Chem. Jun. 11, 2004;279(24):25823-9. Epub Mar. 26, 2004.

Leduc et al., Helix-stabilized cyclic peptides as selective inhibitors of steroid receptor-coactivator interactions. Proc Natl Acad Sci USA. 2003;100(20):11273-78.

Lee, et al. A novel BH3 ligand that selectively targets Mcl-1 reveals that apoptosis can proceed without Mcl-1 degradation. J Cell Biol. Jan. 28, 2008;180(2):341-355.

Lee, et al. Novel pyrrolopyrimidine-based α-helix mimetics: cell-permeable inhibitors of protein-protein interactions. J Am Chem Soc. Feb. 2, 2011;133(4):676-9. doi: 10.1021/ja108230s.

Lenntech BV Water Treatment Solutions. http://www.lenntech.com/periodic/elements/ru.htm.Copyright © 1998-2014.

Lenos, et al. (2012). Alternate splicing of the p53 inhibitor HDMX offers a superior prognostic biomarker than p53 mutation in human cancer. Cancer Res 72, 4074-4084.

Letai, et al. Distinct BH3 Domains Either Sensitize or Activate Mitochondrial Apoptosis, Serving as Prototype Cancer Therapeutics. Cancer Cell. 2002; 2:183-192.

Lewis et al., Apoptosis in T cell acute lymphoblastic leukemia cells after cell cycle arrest induced by pharmacological inhibition of notch signaling. Chem Biol. Feb. 2007;14(2):209-19.

Li, et al. (2012). Activation of p53 by SIRT1 inhibition enhances elimination of CML leukemia stem cells in combination with imatinib. Cancer Cell 21, 266-281.

Li, et al. (2014). MDM4 overexpressed in acute myeloid leukemia patients with complex karyotype and wild-type TP53. PLoS One 9, e113088.

Li, et al. A convenient preparation of 5-iodo-1,4-disubstituted-1,2,3-triazole: multicomponent one-pot reaction of azide and alkyne mediated by CuI-NBS. J Org Chem. May 2, 2008;73(9):3630-3. doi: 10.1021/jo800035v. Epub Mar. 22, 2008.

Li et al., Alagille syndrome is caused by mutations in human Jagged1, which encodes a ligand for Notch1. Nat Genet. Jul. 1997;16(3):243-51.

Li, et al. Application of Olefin Metathesis in Organic Synthesis. Speciality Petrochemicals. 2007; 79-82 (in Chinese with English abstract).

Li et al., Modulation of Notch signaling by antibodies specific for the extracellular negative regulatory region of NOTCH3. J Biol Chem. Mar. 21, 2008;283(12):8046-54. doi: 10.1074/jbc.M800170200. Epub Jan. 8, 2008.

Li et al., Notch3 signaling promotes the development of pulmonary arterial hypertension. Nat Med. Nov. 2009;15(11):1289-97. doi: 10.1038/nm.2021. Epub Oct. 25, 2009.

Li, et al. Structure-based design of thioether-bridged cyclic phosphopeptides binding to Grb2-SH2 domain. Bioorg Med Chem Lett. Mar. 10, 2003;13(5):895-9.

Li, et al. Systematic mutational analysis of peptide inhibition of the p53-MDM2/MDMX interactions. J Mol Biol. Apr. 30, 2010;398(2):200-13. doi: 10.1016/j.jmb.2010.03.005. Epub Mar. 10, 2010.

Li, et at. Molecular-targeted agents combination therapy for cancer: Developments and potentials. International Journal of Cancer 134.6 (2014): 1257-1269.

Liang et al., Wnt5a inhibits B cell proliferation and functions as a tumor suppressor in hematopoietic tissue. Cancer Cell. Nov. 2003;4(5):349-60.

Lifson & Roig, On the Theory of Helix-coil Transition in Polypeptides, J. Chem. Phys. 34(6):1963-1974 (1961).

Lindsay et al., Rab coupling protein (RCP), a novel Rab4 and RabII effector protein. J Biol Chem. Apr. 5, 2002;277(14):12190-9. Epub Jan. 10, 2002.

Liskamp, et al. Conformationally restricted amino acids and dipeptides, (non)peptidomimetics and secondary structure mimetics. Recl Travl Chim Pays-Bas. 1994; 113:1-19.

Litowski & Hodges, Designing Heterodimeric Two-stranded α-Helical Coiled-coils: Effects of Hydrophobicity and α-Helical Propensity on Protein Folding, Stability, and Specificity, J. Biol. Chem. 277(40):37272-37279 (2002).

Little et aL, A Mutation in the LDL Receptor-Related Protein 5 Gene Results in the Autosomal Dominant High-Bone-Mass Trait. Am J Hum Genet. 2002;70:11-19.

Liu, et al. (2009). The p53 tumor suppressor protein is a critical regulator of hematopoietic stem cell behavior. Cell Cycle 8, 3120-3124.

Liu et al., Chemical Ligation Approach to Form a Peptide Bond between Unprotected Peptide Segments. Concept and Model Study. J Am Chem Soc. 1994;116(10):4149-53.

Liu et al., Targeted degradation of beta-catenin by chimeric F-box fusion proteins. Biochem Biophys Res Commun. Jan. 23, 2004;313(4)1023-9.

Lo et al., Phosphorylation by the beta-catenin/MAPK complex promotes 14-3-3-mediated nuclear export of TCF/POP-1 in signal-responsive cells in C. elegans. Cell. Apr. 2, 2004;117(1):95-106.

Logan et al., The Wnt signaling pathway in development and disease. Annu Rev Cell Dev Biol. 2004;20:781-810.

Losey et al., Crystal structure of *Staphylococcus aureus* tRNA adenosine deaminase TadA in complex with RNA. Nat Struct Mol Biol. Feb. 2006;13(2):153-9. Epub Jan. 15, 2006.

Lou et al., The first three domains of the insulin receptor differ structurally from the insulin-like growth factor 1 receptor in the regions governing ligand specificity. Proc Natl Acad Sci U S A. Aug. 15, 2006;103(33):12429-34. Epub Aug. 7, 2006.

Loughlin et al., Functional variants within the secreted frizzled-related protein 3 gene are associated with hip osteoarthritis in females. Proc Natl Acad Sci U S A. Jun. 29, 2004;101(26):9757-62. Epub Jun. 21, 2004.

Lu et al., Both Pbx1 and E2A-Pbx1 bind the DNA motif ATCAATCAA cooperatively with the products of multiple murine Hox genes, some of which are themselves oncogenes. Mol Cell Biol. Jul. 1995;15(7):3786-95.

Lu, et al. Proteomimetic libraries: design, synthesis, and evaluation of p53-MDM2 interaction inhibitors. J Comb Chem. May-Jun. 2006;8(3):315-25.

Lu et al., Structural determinants within Pbx1 that mediate cooperative DNA binding with pentapeptide-containing Hox proteins: proposal for a model of a Pbx1-Hox-DNA complex. Mol Cell Biol. Apr. 1996;16(4):1632-40.

Lubman et al., Quantitative dissection of the Notch:CSL interaction: insights into the Notch-mediated transcriptional switch. J Mol Biol. Jan. 19, 2007;365(3):577-89. Epub Oct. 3, 2006.

(56) References Cited

OTHER PUBLICATIONS

Luo, et al. Mechanism of helix induction by trifluoroethanol: a framework for extrapolating the helix-forming properties of peptides from trifluoroethanol/water mixtures back to water. Biochemistry. Jul. 8, 1997;36(27):8413-21.

Luo et al., Wnt signaling and human diseases: what are the therapeutic implications? Lab Invest. Feb. 2007;87(2):97-103. Epub Jan. 8, 2007.

Luscher et al., The basic region/helix-loop-helix/leucine zipper domain of Myc proto-oncoproteins: function and regulation. Oncogene. May 13, 1999;18(19):2955-66.

Luu et al, Wnt/beta-catenin signaling pathway as a novel cancer drug target. Curr Cancer Drug Targets. Dec. 2004;4(8):653-71.

Lyu, et al. Capping Interactions in Isolated α Helices: Position-dependent Substitution Effects and Structure of a Serine-capped Peptide Helix. Biochemistry. 1993; 32:421-425.

Lyu et al, α-Helix Stabilization by Natural and Unnatural Amino Acids with Alkyl Side Chains, Proc. Nat'l Acad. Sci. USA 88:5317-5320 (1991).

Macmillan, Evolving strategies for protein synthesis converge on native chemical ligation. Angew Chem Int Ed Engl. Nov. 27, 2006;45(46):7668-72.

Madden, et al. Synthesis of cell-permeable stapled peptide dual inhibitors of the p53-Mdm2/Mdmx interactions via photoinduced cycloaddition. Bioorg Med Chem Lett. Mar. 1, 2011;21(5):1472-5. doi: 10.1016/j.bmcl.2011.01.004. Epub Jan. 7, 2011.

Mai, et al. A proapoptotic peptide for the treatment of solid tumors. Cancer Research. 2001; 61:7709-7712.

Mangold, et al. Azidoalanine mutagenicity in *Salmonella*: effect of homologation and alpha-Mutat Res. Feb. 1989;216(1):27-33.methyl substitution.

Mannhold, R et al. Molecular Drug Properties: Measurement and Prediction (Methods and Principles in Medicinal Chemistry). Wiley-VCH; 2007.

Marqusee & Baldwin, Helix Stabilization by Glu- . . . Lys+ Salt Bridges in Short Peptides of De Novo Design, Proc. Nat'l Acad. Sci. USA 84:8898-8902 (1987).

Marshall et al., Back to the future: ribonuclease A. Biopolymers. 2008;90(3):259-77.

Martin, et al. Thermal [2+2] intramolecular cycloadditions of fuller-1,6-enynes. Angew Chem Int Ed Engl. Feb. 20, 2006;45(9):1439-42.

Maynard, et al. Purification technique for the removal of ruthenium from olefin metathesis reaction products. Tetrahedron Letters. 1999; 40:4137-4140.

McGahon, et al. The end of the (cell) line: methods for the study of apoptosis in vitro. Methods Cell Biol. 1995;46:153-85.

McKern et al., Structure of the insulin receptor ectodomain reveals a folded-over conformation. Nature. Sep. 14, 2006;443(7108):218-21. Epub Sep. 6, 2006.

McNamara et al. Peptides constrained by an aliphatic linkage between two C(alpha) sites: design, synthesis, and unexpected conformational properties of an i,(i + 4)-linked peptide. J Org Chem. Jun. 29, 2001;66(13):4585-95.

Mellegaard-Waetzig et al., Allylic amination via decarboxylative c-n bond formation Synlett. 2005;18:2759-2762.

Menting et al., A thermodynamic study of ligand binding to the first three domains of the human insulin receptor: relationship between the receptor alpha-chain C-terminal peptide and the site 1 insulin mimetic peptides. Biochemistry. Jun. 16, 2009;48(23):5492-500. doi: 10.1021/bi900261q.

Meyers et al., Formation of mutually exclusive RabII complexes with members of the family of RabII-interacting proteins regulates RabII endocytic targeting and function. J Biol Chem. Dec. 13, 2002;277(50):49003-10. Epub Oct. 9, 2002.

Miller & Scanlan, oNBS-SPPS: A New Method for Solid-phase Peptide Synthesis, J. Am. Chem. Soc. 120:2690-2691 (1998).

Miller et al., Application of Ring-Closing Metathesis to the Synthesis of Rigidified Amino Acids and Peptides. J Am Chem Soc. 1996;118(40):9606-9614.

Miller et al., Synthesis of Conformationally Restricted Amino Acids and Peptides Employing Olefin Metathesis. J Am Chem Soc. 1995;117(21):5855-5856.

Miloux et al., Cloning of the human IL-13R alphaI chain and reconstitution with the IL4R alpha of a functional IL-4/IL-13 receptor complex. FEBS Lett. Jan. 20, 1997;401(2-3):163-6.

Miyaoka et al., Increased expression of Wnt-1 in schizophrenic brains. Schizophr Res. Jul. 27, 1999;38(1):1-6.

Moellering et al., Abstract 69. Computational modeling and molecular optimization of stabilized alpha-helical peptides targeting NOTCH-CSL transcriptional complexes. Nov. 2010; 8(7):30. DOI: 10.1016/S1359-6349(10)71774-2. Abstract Only, European Journal of Cancer Supplements, 2010, 8(7).

Moellering et al., Computational modeling and molecular optimization of stabilized alphahelical peptides targeting NOTCH-CSL transcriptional complexes. European Journal of Cancer Supplements Nov. 2010; 8(7):30. DOI: 10.1016/S1359-6349(10)71774-2. Abstract 69.

Moellering et al., Direct inhibition of the NOTCH transcription factor complex. Nature. Nov. 12, 2009;462(7270):182-8. Erratum in: Nature. Jan. 21, 2010;463(7279):384.

Moon et al., WNT and beta-catenin signalling: diseases and therapies. Nat Rev Genet. Sep. 2004;5(9):689-701.

Morin, beta-catenin signaling and cancer. Bioessays. Dec. 1999;21(12):1021-30.

Mosberg, et al. Dithioeter-containing cyclic peptides. J. Am. Chem. Soc. 1985;107(10):2986-2987.

Moses, et al. The growing applications of click chemistry. Chem Soc Rev. Aug. 2007;36(8):1249-62.

Moy et al., Solution structure of human IL-13 and implication for receptor binding. J Mol Biol. Jun. 29, 2001;310(1):219-30.

Muchmore, et al. X-ray and NMR structure of human Bcl-xL, an inhibitor of programmed cell death. Nature. May 23, 1996;381(6580):335-41.

Mudher et al., Alzheimer's disease—do tauists and baptists finally shake hands? Trends Neurosci. Jan. 2002;25(1):22-6.

Muir et al., Expressed protein ligation: a general method for protein engineering. Proc Natl Acad Sci U S A. Jun. 9, 1998;95(12):6705-10.

Muir, Semisynthesis of proteins by expressed protein ligation. Annu Rev Biochem. 2003;72:249-89. Epub Feb. 27, 2003.

Muller, P. Glossary of terms used in physical organic chemistry. Pure and Applied Chemistry, 1994, vol. 66, pp. 1077-1184.

Mulqueen et al. Synthesis of the thiazoline-based siderophore (S)-desferrithiocin. 1993;48(24):5359-5364.

Muppidi, et al. Achieving cell penetration with distance-matching cysteine cross-linkers: a facile route to cell-permeable peptide dual inhibitors of Mdm2/Mdmx. Chem Commun (Camb). Sep. 7, 2011;47(33):9396-8. doi: 10.1039/c1cc13320a. Epub Jul. 19, 2011.

Muppidi et al., Conjugation of spermine enhances cellular uptake of the stapled peptide-based inhibitors of p53-Mdm2 interaction. Bioorg Med Chem Lett. Dec. 15, 2011;21(24):7412-5. doi: 10.1016/j.bmcl.2011.10.009. Epub Oct. 12, 2011.

Murray, et al. Targeting protein-protein interactions: lessons from p53/MDM2. Biopolymers. 2007;88(5):657-86.

Mustapa, et al. Synthesis of a Cyclic Peptide Containing Norlanthionine: Effect of the Thioether Bridge on Peptide Conformation. J. Org. Chem. 2003;68(21):8193-8198.

Mynarcik et al., Alanine-scanning mutagenesis of a C-terminal ligand binding domain of the insulin receptor alpha subunit. J Biol Chem. Feb. 2, 1996;271(5):2439-42.

Mynarcik et al., Identification of common ligand binding determinants of the insulin and insulin-like growth factor 1 receptors. Insights into mechanisms of ligand binding. J Biol Chem. Jul. 25, 1997;272(30):18650-5.

Myriem, V. One pot iodination click reaction: A Convenient Preparation of 5-Iodo-1,4-disubstituted-1,2,3-triazole. Date unknown.

Myung et al., The ubiquitin-proteasome pathway and proteasome inhibitors. Med Res Rev. Jul. 2001;21(4):245-73.

Nair et al., X-ray structures of Myc-Max and Mad-Max recognizing DNA. Molecular bases of regulation by proto-oncogenic transcription factors. Cell. Jan. 24, 2003;112(2):193-205.

(56) References Cited

OTHER PUBLICATIONS

Nakashima et al., Cross-talk between Wnt and bone morphogenetic protein 2 (BMP-2) signaling in differentiation pathway of C2C12 myoblasts. J Biol Chem. Nov. 11, 2005;280(45):37660-8. Epub Sep. 2, 2005.

Nam et al., Structural basis for cooperativity in recruitment of MAML coactivators to Notch transcription complexes. Cell. Mar. 10, 2006;124(5):973-83.

Nam et al., Structural requirements for assembly of the CSL. intracellular NotchI.Mastermind-like 1 transcriptional activation complex. J Biol Chem. Jun. 6, 2003;278(23):21232-9. Epub Mar. 18, 2003.

Nefedova et al., Involvement of Notch-1 signaling in bone marrow stroma-mediated de novo drug resistance of myeloma and other malignant lymphoid cell lines. Blood. May 1, 2004;103(9):3503-10. Epub Dec. 11, 2003.

Nelson & Kallenbach, Persistence of the α-Helix Stop Signal in the S-Peptide in Trifluoroethanol Solutions, Biochemistry 28:5256-5261 (1989).

Ngo et al. Computational complexity, protein structure prediction, and the levinthal paradox. In: The Protein Folding Problem and Tertiary Structure Prediction. K. Merz, Jr., et al. Eds. 1994:433-506.

Ngo et al. Computational complexity, protein structure prediction and the Levinthal Paradox.In: The Protein Folding Problem and Tertiary Structure Prediction. K.Merz, Jr. and S. LeGrand, eds., 1994, pp. 491-495.

Niemann et al., Homozygous WNT3 mutation causes tetra-amelia in a large consanguineous family. Am J Hum Genet. Mar. 2004;74(3):558-63. Epub Feb. 5, 2004.

Nilsson et al., Staudinger ligation: a peptide from a thioester and azide. Org Lett. Jun. 29, 2000;2(13):1939-41.

Niranjan et al., The Notch pathway in podocytes plays a role in the development of glomerular disease. Nat Med. Mar. 2008;14(3):290-8. doi: 10.1038/nm1731. Epub Mar. 2, 2008.

Nishisho et al., Mutations of chromosome 5q21 genes in FAP and colorectal cancer patients. Science. Aug. 9, 1991;253(5020):665-9.

Nobuo Izimiya et al. Pepuchido Gosei no Kiso to Jikken (Fundamental of peptide synthesis and experiments, Jan. 20, 1985, p. 271.

Node et al., Hard Acid and Soft Nucleophile Systems. 3. Dealkylation of Esters with Aluminum Halide-Thiol and Aluminum Halide-Sulfide Stustems. J Org Chem. 1981;46:1991-93.

Noguera-Troise et al., Blockade of D114 inhibits tumour growth by promoting nonproductive angiogenesis. Nature. Dec. 21, 2006;444(7122):1032-7.

O'Shea et al., Mechanism of Specificity in the Fos-Jun Oncoprotein Heterodimer, Cell 68:699-708 (1992).

Okamura et al., Redundant regulation of T cell differentiation and TCRalpha gene expression by the transcription factors LEF-1 and TCF-1. Immunity. Jan. 1998;8(1):11-20.

Oliner, et al. Oncoprotein MDM2 conceals the activation domain of tumour suppressor p53. Nature. Apr. 29, 1993;362(6423):857-60.

Olson et al., Sizing up the heart: development redux in disease. Genes Dev. Aug. 15, 2003;17(16):1937-56. Epub Jul. 31, 2003.

O'Neil & DeGrado, A Thermodynamic Scale for the Helix-forming Tendencies of the Commonly Occurring Amino Acids, Science 250:646-651(1990).

O'Neil et al., FBW7 mutations in leukemic cells mediate NOTCH pathway activation and resistance to gamma-secretase inhibitors. J Exp Med. Aug. 6, 2007;204(8):1813-24. Epub Jul. 23, 2007.

Or et al. Cysteine alkylation in unprotected peptides: synthesis of a carbavasopressin analogue by intramolecular cystein alkylation. J. Org. Chem. Apr. 1991;56(9):3146-3149.

Oswald et al., RBP-Jkappa/SHARP recruits CtIP/CtBP corepressors to silence Notch target genes. Mol Cell Biol. Dec. 2005;25(23):10379-90.

Pakotiprapha et al., Crystal structure of Bacillus stearothermophilus UvrA provides insight into ATP-modulated dimerization, UvrB interaction, and DNA binding. Mol Cell. Jan. 18, 2008;29(1):122-33. Epub Dec. 27, 2007.

Palchaudhuriet al.,Differentiation induction in acute myeloid leukemia using site-specific DNA-targeting. 55th ASH Annual Meeting and Exposition. Dec. 9, 2013. Accessed at https://ash.confex.com/ash/2013/webprogram/Paper60843.html.

Palomero et al., Mutational loss of PTEN induces resistance to NOTCH1 inhibition in T-cell leukemia. Nat Med. Oct. 2007;13(10):1203-10. Epub Sep. 16, 2007.

Pangborn et al., Safe and Convenient Procedure for Solvent Purification, Organometallics 15:1518-1520 (1996).

Paquette, L.A., ed. Encyclopedia of Reagents for Organic Synthesis. New York; John Wiley & Sons; 1995.

Park et al., Notch3 gene amplification in ovarian cancer. Cancer Res. Jun. 15, 2006;66(12):6312-8.

Parrish et al., Perspectives on alkyl carbonates in organic synthesis. Tetrahedron, 2000; 56(42): 8207-8237.

Passegue, et al. (2003). Normal and leukemic hematopoiesis: are leukemias a stem cell disorder or a reacquisition of stem cell characteristics? Proc Natl Acad Sci U S A 100 Suppl 1, 11842-11849.

Patgiri, et al. A hydrogen bond surrogate approach for stabilization of short peptide sequences in alpha-helical conformation. Acc Chem Res. Oct. 2008;41(10):1289-300. Epub Jul. 17, 2008.

Patgiri et al. An orthosteric inhibitor of the Ras-Sos interaction. Nat Chem Bio 7:585-587 (2011).

Patgiri, et al. Solid phase synthesis of hydrogen bond surrogate derived alpha-helices: resolving the case of a difficult amide coupling. Org Biomol Chem. Apr. 21, 2010;8(8):1773-6.

Pattenden, et al. Enantioselective synthesis of 2-alkyl substituted cysteines. 1993;49(10):2131-2138.

Pattenden, et al. Naturally occurring linear fused thiazoline-thiazole containing metabolites: total synthesis of (-)-didehydromirabazole A, a cytotoxic alkaloid from blue-green algae. J Chem Soc. 1993;14:1629-1636.

Pazgier, et al. Structural basis for high-affinity peptide inhibition of p53 interactions with MDM2 and MDMX. Proc Natl Acad Sci U S A. Mar. 24, 2009;106(12):4665-70. doi: 10.1073/pnas.0900947106. Epub Mar. 2, 2009.

Peller, et al. (2003). TP53 in hematological cancer: low incidence of mutations with significant clinical relevance. Hum Mutat 21, 277-284.

Pellois et al., Semisynthetic proteins in mechanistic studies: using chemistry to go where nature can't. Curr Opin Chem Biol. Oct. 2006;10(5):487-91. Epub Aug. 28, 2006.

Perantoni, Renal development: perspectives on a Wnt-dependent process. Semin Cell Dev Biol. Aug. 2003;14(4):201-8.

Peryshkov, et al. Z-Selective olefin metathesis reactions promoted by tungsten oxo alkylidene complexes. Am Chem Soc. Dec. 28, 2011;133(51):20754-7. doi: 10.1021/ja210349m. Epub Nov. 30, 2011.

Petros et al., Rationale for Bcl-xL/Bad Peptide Complex Formation from Structure, Mutagenesis, and Biophysical Studies, Protein Sci. 9:2528-2534 (2000).

Phan, et al. Structure-based design of high affinity peptides inhibiting the interaction of p53 with MDM2 and MDMX. J Biol Chem. Jan. 15, 2010;285(3):2174-83. doi: 10.1074/jbc.M109.073056. Epub Nov. 12, 2009.

Phelan, et al. A General Method for Constraining Short Peptides to an α-Helical Conformation. J. Am. Chem. Soc. 1997;119:455-460.

Pillutla et al., Peptides identify the critical hotspots involved in the biological activation of the insulin receptor. J Biol Chem. Jun. 21, 2002;277(25):22590-4. Epub Apr. 18, 2002.

Pinnix et al., Active Notch1 confers a transformed phenotype to primary human melanocytes. Cancer Res. Jul. 1, 2009;69(13):5312-20. doi: 10.1158/0008-5472.CAN-8-3767. Epub Jun. 23, 2009.

Plenat, et al. [Formaldehyde fixation in the third millennium]. Ann Pathol. Feb. 2001;21(1):29-47.

Polakis, The oncogenic activation of beta-catenin. Curr Opin Genet Dev. Feb. 1999;9(1):15-21.

Punna, et al. Head-to-tail peptide cyclodimerization by copper-catalyzed azide-alkyne cycloaddition. Angew Chem Int Ed Engl. Apr. 8, 2005;44(15):2215-20.

(56) References Cited

OTHER PUBLICATIONS

Qi, J., et al. (2015). HDAC8 Inhibition Specifically Targets Inv(16) Acute Myeloid Leukemic Stem Cells by Restoring p53 Acetylation. Cell Stem Cell 17, 597-610.
Qian & Schellman, Helix-coil Theories: A Comparative Study for Finite Length Polypeptides, J. Phys. Chem. 96:3987-3994 (1992).
Qiu et al., Convenient, Large-Scale Asymmetric Synthesis of Enantiomerically Pure trans-Cinnamylglycine and -a-Alanine. Tetrahedron. 2000;56:2577-82.
Ran, et al. Double Nicking by RNA-Guided CRISPR Cas9 for Enhanced Genome Editing Specificity. Cell. Aug. 28, 2013. pii: S0092-8674(13)01015-5. doi: 10.1016/j.cell.2013.08.021. [Epub ahead of print].
Rao et al., Inhibition of NOTCH signaling by gamma secretase inhibitor engages the RB pathway and elicits cell cycle exit in T-cell acute lymphoblastic leukemia cells. Cancer Res. Apr. 1, 2009;69(7):3060-8. doi: 10.1158/0008-5472.CAN-08-4295. Epub Mar. 24, 2009.
Rasmussen, et al. Ruthenium-catalyzed cycloaddition of aryl azides and alkynes. Org Lett. Dec. 20, 2007;9(26):5337-9.
Rawlinson et al., CRM1-mediated nuclear export of dengue virus RNA polymerase NS5 modulates interleukin-8 induction and virus production. J Biol Chem. Jun. 5, 2009;284(23):15589-97. Epub Mar. 18, 2009.
Reis, et al. (2016). Acute myeloid leukemia patients' clinical response to idasanutlin (RG7388) is associated with pre-treatment MDM2 protein expression in leukemic blasts. Haematologica 101, e185-188.
Reya et al., Wnt signalling in stem cells and cancer. Nature. Apr. 14, 2005;434(7035):843-50.
Rich et al., Synthesis of the cytostatic cyclic tetrapeptide, chlamydocin. Tetranderon Letts. 1983;24(48):5305-08.
Riddoch, et al. A solid-phase labeling strategy for the preparation of technetium and rhenium bifunctional chelate complexes and associated peptide conjugates. Bioconjug Chem. Jan.-Feb. 2006;17(1):226-35.
Ridgway et al., Inhibition of Dll4 signalling inhibits tumour growth by deregulating angiogenesis. Nature. Dec. 21, 2006;444(7122):1083-7.
Rink, et al. Lantibiotic Structures as Guidelines for the Design of Peptides That Can Be Modified by Lantibiotic Enzymes. Biochemistry. 2005; 44:8873-8882.
Robert, A hierarchical nesting approach to describe the stability of alpha helices with side-chain interactions. Biopolymers. 1990;30(3-4):335-47.
Roberts, et al. Efficient synthesis of thioether-based cyclic peptide libraries. Tetrahedon Letters. 1998; 39: 8357-8360.
Roberts, et al. Examination of methodology for the synthesis of cyclic thioether peptide libraries derived from linear tripeptides. J Pept Sci. Dec. 2007;13(12):811-21.
Robitaille et al., Mutant frizzled-4 disrupts retinal angiogenesis in familial exudative vitreoretinopathy. Nat Genet. Oct. 2002;32(2):326-30. Epub Aug. 12, 2002.
Rodova et al., The polycystic kidney disease-1 promoter is a target of the beta-catenin/T-cell factor pathway. J Biol Chem. Aug. 16, 2002;277(33):29577-83. Epub Jun. 4, 2002.
Roehrl et al., A General Framework for Development and Data Analysis of Competitive High-throughput Screens for Small-molecule Inhibitors of Protein-Protein Interactions by Fluorescence Polarization, Biochemistry 43:16056-16066 (2004).
Roehrl et al., Discovery of Small-molecule Inhibitors of the NFAT-Calcineurin Interaction by Competitive High-throughput Fluorescence Polarization Screening, Biochemistry 43:16067-16075 (2004).
Rojo, et al. Macrocyclic peptidomimetic inhibitors of β-secretase (BACE): First X-ray structure of a macrocyclic peptidomimetic-BACE complex. Bioorg. Med. Chem. Lett. 2006; 16:191-195.
Roof, et al. Mechanism of action and structural requirements of constrained peptide inhibitors of RGS proteins. Chem Biol Drug Des. Apr. 2006;67(4):266-74.

Roos et al., Synthesis of a-Substituted a-Amino Acids via Cationic Intermediates. J Org Chem. 1993;58:3259-68.
Ross et al. Inhibition of adipogenesis by Wnt signaling. Science 289:950-953 (2000).
Rostovtsev et al. A stepwise huisgen cycloaddition process: copper (i)-catalyzed regioselective ligation of azides and terminal alkynes. Angew. Chem. Int. Ed. Engl. 41(14):2596-2599 (2002).
Ruan et al., Metal Ion Enhanced Helicity in Synthetic Peptides Containing Unnatural, Metal-ligating Residues, J. Am. Chem. Soc. 112:9403-9404 (1990).
Rudinger J, Characteristics of the amino acids as components of a peptide hormone sequence, Peptide Hormones, JA Parsons Edition, University Park Press, Jun. 1976, pp. 1-7.
Ruffolo and Shore. BCL-2 Selectively Interacts with the BID-Induced Open Conformer of BAK, Inhibiting BAK Auto-Oligomerization. J. Biol. Chern. 2003;278(27):25039-25045.
Rutledge et al., A View to a Kill: Ligands for Bcl-2 Family Proteins, Curr. Opin. Chem. Biol. 6:479-485 (2002).
Rytting, et al. Overview of Leukemia. Available at http://www.merckmanuals.com/home/blood-disorders/leukemias/overview-of%20leukemia?qt=Leukemia&2520alt=sh. Accessed on Jun. 29, 2016.
Sadot et al., Down-regulation of beta-catenin by activated p53. Mol Cell Biol. Oct. 2001;21(20):6768-81.
Saghiyan, A. S., et al., New chiral Niii complexes of Schiffs bases of glycine and alanine for efficient asymmetric synthesis of a-amino acids, Tedrahedron: Asymmetry 17: 455-467 (2006).
Saghiyan, et al. Novel modified (S)-N-(benzoylphenyl)-1-(3,4-dichlorobenzyl)-pyrolidine-2-carboxamide derived chiral auxiliarie for asymmetric synthesis of (S)-alpha-amino acids. Chemical Journal of Armenia. Aug. 2002; 55(3):150-161. (abstract only).
Saiki, et al. Primer-directed enzymatic amplification of DNA with a thermostable DNA polymerase. Science. Jan. 29, 1988;239(4839):487-91.
Sali et al., Stabilization of protein structure by interaction of alpha-helix dipole with a charged side chain. Nature. Oct. 20, 1988;335(6192):740-3.
Sampietro et al., Crystal structure of a beta-catenin/BCL9/Tcf4 complex. Mol Cell. Oct. 20, 2006;24(2):293-300.
Sanchez-Garcia, et al. Tumorigenic activity of the BCR-ABL oncogenes is mediated by BCL2. Proc Natl Acad Sci U S A. Jun. 6, 1995;92(12):5287-91.
Ösapay & Taylor, Multicyclic Polypeptide Model Compounds. 2. Synthesis and Conformational Properties of a Highly α-Helical Uncosapeptide Constrained by Three Side-chain to Side-chain Lactam Bridges, J. Am. Chem. Soc. 114:6966-6973 (1992).
Satoh et al., AXIN1 mutations in hepatocellular carcinomas, and growth suppression in cancer cells by virus-mediated transfer of AXIN1. Nat Genet. Mar. 2000;24(3):245-50.
Sattler et al. Structure of Bcl-xL-Back peptide complex: recognition between regulators of apoptosis. Science. 275:983-986 (1997).
Saxon et al., Cell surface engineering by a modified Staudinger reaction. Science. Mar. 17, 2000;287(5460):2007-10.
Schaffer et al., A novel high-affinity peptide antagonist to the insulin receptor. Biochem Biophys Res Commun. Nov. 14, 2008;376(2):380-3. doi: 10.1016/j.bbrc.2008.08.151. Epub Sep. 7, 2008.
Schaffer et al., Assembly of high-affinity insulin receptor agonists and antagonists from peptide building blocks. Proc Natl Acad Sci U S A. Apr. 15, 2003;100(8):4435-9. Epub Apr. 8, 2003.
Scheffzek et al. The Ras-RasGAP complex: structural basis for GTPase activation and its loss in oncogenic Ras mutants. Science 277(5324):333-338 (1997).
Schinzel et al., The phosphate recognition site of Escherichia coli maltodextrin phosphorylase. FEBS Lett. Jul. 29, 1991;286(1-2):125-8.
Schmiedeberg et al. Reversible backbone protection enables combinatorial solid-phase ring-closing metathesis reaction (RCM) in peptides. Org Lett. Jan. 10, 2002;4(1):59-62.
Scholtz et al., The mechanism of alpha-helix formation by peptides. Annu Rev Biophys Biomol Struct. 1992;21:95-118.
Schrock et al., Tungsten(VI) Neopentylidyne Complexes. Organometallics. 1982;1:1645-51.

(56) References Cited

OTHER PUBLICATIONS

Schwarzer et al., Protein semisynthesis and expressed protein ligation: chasing a protein's tail. Curr Opin Chem Biol. Dec. 2005;9(6):561-9. Epub Oct. 13, 2005.

Scorrano, et al. A distinct pathway remodels mitochondrial cristae and mobilizes cytochrome c during apoptosis. Dev Cell. Jan. 2002;2(1):55-67.

Scott, et al. A Solid-Phase Synthetic Route to Unnatural Amino Acids with Diverse Side-Chain Substitutions. Journal of Organic Chemistry. 2002, vol. 67, No. 9, pp. 2960-2969.

Scott et al., Evidence of insulin-stimulated phosphorylation and activation of the mammalian target of rapamycin mediated by a protein kinase B signaling pathway. Proc Natl Acad Sci U S A. Jun. 23, 1998;95(13):7772-7.

Seabra et al., Rab GTPases, intracellular traffic and disease. Trends Mol Med. Jan. 2002;8(1):23-30.

Seebach, et al. Beta-peptidic peptidomimetics. Acc Chem Res. Oct. 2008;41(10):1366-75. doi: 10.1021/ar700263g. Epub Jun. 26, 2008.

Seebach, et al. Self-Regeneration of Stereocenters (SRS)—Applications, Limitations, and Abandonment of a Synthetic Principle. Angew. Chem. Int. Ed. Engl. 1996;35:2708-2748.

Seebeck, et al. Ribosomal synthesis of dehydroalanine-containing peptides. J Am Chem Soc. Jun. 7, 2006;128(22):7150-1.

Seiffert et al., Presenilin-1 and -2 are molecular targets for gamma-secretase inhibitors. J Biol Chem. Nov. 3, 2000;275(44):34086-91.

Shair, A closer view of an oncoprotein-tumor suppressor interaction. Chem Biol. Nov. 1997;4(11):791-4.

Shangary, et al. Targeting the MDM2-p53 interaction for cancer therapy. Clin Cancer Res. Sep. 1, 2008;14(17):5318-24. doi: 10.1158/1078-0432.CCR-07-5136.

Sharp, et al. (1999). Stabilization of the MDM2 oncoprotein by interaction with the structurally related MDMX protein. J Biol Chem 274, 38189-38196.

Shenk, et al. Biochemical method for mapping mutational alterations in DNA with S1 nuclease: the location of deletions and temperature-sensitive mutations in simian virus 40. Proc Natl Acad Sci U S A. Mar. 1975;72(3):989-93.

Shepherd et al., Single Turn Peptide Alpha Helices with Exceptional Stability in Water, J. Am. Chem. Soc. 127:2974-2983 (2005).

Shi, et al. The role of arsenic-thiol interactions in metalloregulation of the ars operant. J Biol Chem. Apr. 19, 1996;271(16):9291-7.

Shiba et al., Structural basis for RabII-dependent membrane recruitment of a family of RabII-interacting protein 3 (FIP3)/Arfophilin-1. Proc Natl Acad Sci U S A. Oct. 17, 2006;103(42):15416-21. Epub Oct. 9, 2006.

Shvarts, et al. (1996). MDMX: a novel p53-binding protein with some functional properties of MDM2. EMBO J 15, 5349-5357.

Si et aL, CCN1/Cyr61 is regulated by the canonical Wnt signal and plays an important role in Wnt3A-induced osteoblast differentiation of mesenchymal stem cells. Mol Cell Biol. Apr. 2006;26(8):2955-64.

Sia et al., Short Constrained Peptides that Inhibit HIV-1 Entry, Proc. Nat'l Acad. Sci. USA 99(23):14664-14669 (2002).

Siddle et al., Specificity in ligand binding and intracellular signalling by insulin and insulin-like growth factor receptors. Biochem Soc Trans. Aug. 2001;29(Pt 4):513-25.

Singh, et al. Efficient asymmetric synthesis of (S)- and (R)-N-Fmoc-S-trityl-alpha-methylcysteine using camphorsultam as a chiral auxiliary.. J Org Chem. Jun. 25, 2004;69(13):4551-4.

Singh et al.,Iridium(I)-catalyzed regio- and enantioselective allylic amidation.Tet. Lett. 2007;48 (40): 7094-7098.

Skinner et al., Basic helix-loop-helix transcription factor gene family phylogenetics and nomenclature. Differentiation. Jul. 2010;80(1):1-8. doi: 10.1016/j.diff.2010.02.003. Epub Mar. 10, 2010.

Smith, et al. Design, Synthesis, and Binding Affinities of Pyrrolinone-Based Somatostatin Mimetics. Organic Letters. Jan. 8, 2005, vol. 7, No. 3, pp. 399-402, plus Supporting Information, pp. S1-S39.

Smith et al., Structural resolution of a tandem hormone-binding element in the insulin receptor and its implications for design of peptide agonists. Proc Natl Acad Sci U S A. Apr. 13, 2010;107(15):6771-6. doi: 10.1073/pnas.1001813107. Epub Mar. 26, 2010.

Solution phase synthesis from http://www.combichemistry.com/solution_phase_synthesis.html. P.1. Accessed Aug. 6, 2009.

Soucek et al., Modelling Myc inhibition as a cancer therapy. Nature. Oct. 2, 2008;455(7213):679-83. Epub Aug. 17, 2008.

Sparey et al., Cyclic sulfamide gamma-secretase inhibitors. Bioorg Med Chem Lett. Oct. 1, 2005;15(19):4212-6.

Spierings, et al. Connected to death: the (unexpurgated) mitochondrial pathway of apoptosis. Science. 2005; 310:66-67.

Spouge, et al. Strong conformational propensities enhance t cell antigenicity. J Immunol. Jan. 1, 1987;138(1):204-12.

Stad, et al. (2000). Hdmx stabilizes Mdm2 and p53. J Biol Chem 275, 28039-28044.

Stad, et al. (2001). Mdmx stabilizes p53 and Mdm2 via two distinct mechanisms. EMBO Rep 2, 1029-1034.

Stein et al., Rab proteins and endocytic trafficking: potential targets for therapeutic intervention. Adv Drug Deliv Rev. Nov. 14, 2003;55(11):1421-37.

Stenmark et al., The Rab GTPase family. Genome Biol. 2001;2(5):3007. 1-3007.7.

Stewart, et al. Cell-penetrating peptides as delivery vehicles for biology and medicine. Org Biomol Chem. Jul. 7, 2008;6(13):2242-55. doi: 10.1039/b719950c. Epub Apr. 15, 2008.

Still et al., Rapid Chromatographic Technique for Preparative Separations with Moderate Resolution, J. Org. Chem. 43(14):2923-2925 (1978).

Still et al., Semianalytical Treatment of Solvation for Molecular Mechanics and Dynamics. J Am Chem Soc. 1990;112:6127-29.

STN search notes for Lu reference, 4 pages, 2006.

Struhl et al., Presenilin is required for activity and nuclear access of Notch in *Drosophila*. Nature. Apr. 8, 1999;398(6727):522-5.

Stueanaes et al., Beta-adrenoceptor stimulation potentiates insulin-stimulated PKB phosphorylation in rat cardiomyocytes via cAMP and PKA. Br J Pharmacol. May 2010;160(1):116-29. doi: 10.1111/0476-5381.2010.00677.x.

Stymiest, et al. Supporting information for: Solid Phase Synthesis of Dicarba Analogs of the Biologically Active Peptide Hormone Oxytocin Using Ring Closing Metathesis. Organic Letters. 2003. 1-8.

Stymiest, et al. Synthesis of biologically active dicarba analogues of the peptide hormone oxytocin using ring-closing metathesis. Org Lett. Jan. 9, 2003;5(1):47-9.

Su et al., Eradication of pathogenic beta-catenin by Skpl/Cullin/F box ubiquitination machinery. Proc Natl Acad Sci U S A. Oct. 28, 2003;100(22):12729-34. Epub Oct. 16, 2003.

Surinya et al., Role of insulin receptor dimerization domains in ligand binding, cooperativity, and modulation by anti-receptor antibodies. J Biol Chem. May 10, 2002;277(19):16718-25. Epub Mar. 1, 2002.

Suter, et al. (2011). Mammalian genes are transcribed with widely different bursting kinetics. Science 332, 472-474.

Suzuki, et al. Structure of Bax: coregulation of dimer formation and intracellular localization. Cell. Nov. 10, 2002;103(4):645-54.

Szewczuk, et al. Synthesis and Biological activity of new conformationally restricted analogues of pepstatin. Int. J. Peptide Protein. Res. 1992; 40:233-242.

Takeda et al. Human sebaceous tumors harbor inactivating mutations in LEF I . Nat Med. 12(4):395-397 (2006).

Takeishi, et al. (2013). Ablation of Fbxw7 eliminates leukemia-initiating cells by preventing quiescence. Cancer Cell 23, 347-361.

Tam, et al. Protein prosthesis: 1,5-disubstituted[1,2,3]triazoles as cis-peptide bond surrogates. J Am Chem Soc. Oct. 24, 2007;129(42):12670-1.

Tan, et al. (2014). High Mdm4 levels suppress p53 activity and enhance its half-life in acute myeloid leukaemia. Oncotarget 5, 933-943.

Tanaka, Design and synthesis of non-proteinogenic amino acids and secondary structures of their peptides. Yakugaku Zasshi. Oct. 2006:126(10):931-44. Japanese.

Tanimura, et al. (1999). MDM2 interacts with MDMX through their RING finger domains. FEBS Lett 447, 5-9.

(56) References Cited

OTHER PUBLICATIONS

Taylor. The synthesis and study of side-chain lactam-bridged peptides. Biopolymers. 2002;66(1):49-75.

Therasse, et al. New guidelines to evaluate the response to treatment in solid tumors. European Organization for Research and Treatment of Cancer, National Cancer Institute of the United States, National Cancer Institute of Canada. J Natl Cancer Inst. Feb. 2, 2000;92(3):205-16.

Thompson et al., Mutants of interleukin 13 with altered reactivity toward interleukin 13 receptors. J Biol Chem. Oct. 15, 1999;274(42):29944-50.

Thundimadathil, New Reactions with Click Chemistry. An R&D Magazine Webcast. Oct. 10, 2012. Available at http://www.rdmag.com/articles/2012/10/new-reactions-click-chemistry.

Tian et al., Linear non-competitive inhibition of solubilized human gamma-secretase by pepstatin A methylester, L685458, sulfonamides, and benzodiazepines. J Biol Chem. Aug. 30, 2002;277(35):31499-505. Epub Jun. 18, 2002.

Tian et al.; The role of the Wnt-signaling antagonist DKKI in the development of osteolytic lesions in multiple myeloma. N Engl J Med 349:2483-3494 (2003).

Titus, et al. Human K/natural killer cells targeted with hetero-cross-linked antibodies specifically lyse tumor cells in vitro and prevent tumor growth in vivo. J Immunol. Nov. 1, 1987;139(9):3153-8.

Tolbert et al., New methods for proteomic research: preparation of proteins with N-terminal cysteines for labeling and conjugation. Angew Chem Int Ed Engl. Jun. 17, 2002;41(12):2171-4.

Toniolo, Conformationally restricted peptides through short-range cyclizations. Int J Pept Protein Res. Apr. 1990;35(4):287-300.

Toomes et al., Mutations in LRP5 or FZD4 underlie the common familial exudative vitreoretinopathy locus on chromosome 11q. Am J Hum Genet. Apr. 2004;74(4):721-30. Epub Mar. 11, 2004.

Tornoe et al., Peptidotriazoles on solid phase: [1,2,3]-triazoles by regiospecific copper(i)-catalyzed 1,3-dipolar cycloadditions of terminal alkynes to azides. J Org Chem. May 3, 2002;67(9):3057-64.

Torrance et al., Combinatorial chemoprevention of intestinal neoplasia. Nat Med. Sep. 2000;6(9):1024-8.

Torres, et al. Peptide tertiary structure nucleation by side-chain crosslinking with metal complexation and double click cycloaddition. Chembiochem. Jul. 21, 2008;9(11):1701-5.

Trnka & Grubbs, The Development of L2X2Ru=CHR Olefin Metathesis Catalysts: An Organometallic Success Story, Acc. Chem. Res. 34:18-29 (2001).

Tsuji et al., Antiproliferative activity of REIC/Dkk-3 and its significant down-regulation in non-small-cell lung carcinomas. Biochem Biophys Res Commun. Nov. 23, 2001;289(1):257-63.

Tsuji et al., Synthesis of γ, δ-unsaturated ketones by the intramolecular decarboxylative allylation of allyl β-keto carboxylates and alkenyl allyl carbonates catalyzed by molybdenum, nickel, and rhodium complexes. Chemistry Letters. 1984; 13(10):1721-1724.

Tsuruzoe et al., Insulin receptor substrate 3 (IRS-3) and IRS-4 impair IRS-1- and IRS-2-mediated signaling. Mol Cell Biol. Jan. 2001;21(1):26-38.

Tugyi, et al. The effect of cyclization on the enzymatic degradation of herpes simplex virus glycoprotein D derived epitope peptide. J Pept Sci. Oct. 2005;11(10):642-9.

Turner et al., Mitsunobu Glycosylation of Nitrobenzenesulfonamides: Novel Route to Amadori Rearrangement Products, Tetrahedron Lett. 40:7039-7042 (1999).

Tyndall et al. Macrocycles mimic the extended peptide conformation recognized by aspartic, serine, cysteine and metallo proteases. Curr Med Chem. Jul. 2001;8(8):893-907.

Tyndall, et al. Over one hundred peptide-activated G protein-coupled receptors recognize ligands with turn structure. Chem Rev. Mar. 2005;105(3):793-826.

Tyndall et al., Proteases Universally Recognize Beta Strands in Their Active Sites, Chem. Rev. 105:973-999 (2005).

Ueki, et al. Improved synthesis of proline-derived Ni(II) complexes of glycine: versatile chiral equivalents of nucleophilic glycine for general asymmetric synthesis of alpha-amino acids. J Org Chem. Sep. 5, 2003;68(18):7104-7.

Ueki et al., Increased insulin sensitivity in mice lacking p85beta subunit of phosphoinositide 3-kinase. Proc Natl Acad Sci U S A. Jan. 8, 2002;99(1):419-24. Epub Dec. 18, 2001.

Ueki et al., Positive and negative regulation of phosphoinositide 3-kinase-dependent signaling pathways by three different gene products of the p85alpha regulatory subunit. Mol Cell Biol. Nov. 2000;20(21):8035-46.

Ullman et al., Luminescent oxygen channeling immunoassay: measurement of particle binding kinetics by chemiluminescence. Proc Natl Acad Sci U S A. Jun. 7, 1994;91(12):5426-30.

Van Genderen et al., Development of several organs that require inductive epithelial-mesenchymal interactions is impaired in LEF-1-deficient mice. Genes Dev. Nov. 15, 1994;8(22):2691-703.

Van Gijn et al., The wnt-frizzled cascade in cardiovascular disease. Cardiovasc Res. Jul. 2002;55(1):16-24.

Van Hoof, et al. Identification of cell surface proteins for antibody-based selection of human embryonic stem cell-derived cardiomyocytes. J Proteome Res. Mar. 5, 2010;9(3):1610-8. doi: 10.1021/pr901138a.

Van Maarseveen, et al. Efficient route to C2 symmetric heterocyclic backbone modified cyclic peptides. Org Lett. Sep. 29, 2005;7(20):4503-6.

Varallo et al., Beta-catenin expression in Dupuytren's disease: potential role for cell-matrix interactions in modulating beta-catenin levels in vivo and in vitro. Oncogene. Jun. 12, 2003;22(24):3680-4.

Vartak et al., Allosteric Modulation of the Dopamine Receptor by Conformationally Constrained Type VI (3-Turn Peptidomimetics of Pro-Leu-Gly-NH2. J Med Chem. 2007;50(26):6725-6729.

Vassilev, et al. (2004). In vivo activation of the p53 pathway by small-molecule antagonists of MDM2. Science 303, 844-848.

Vassilev, et al. In Vivo Activation of the p53 Pathway by Small-molecule Antagonists of MDM2. Science. 2004; 303:844-848.

Venancio et al., Reconstructing the ubiquitin network: cross-talk with other systems and identification of novel functions. Genome Biol. 2009;10(3):R33. Epub Mar. 30, 2009.

Vera, et al. (2016). Single-Cell and Single-Molecule Analysis of Gene Expression Regulation. Annu Rev Genet 50, 267-291.

Verdine et al., Stapled peptides for intracellular drug targets. Methods Enzymol. 2012;503:3-33. doi: 10.1016/B978-0-12-396962-0.00001-X.

Verdine et al. The challenge of drugging undruggable targets in cancer: lessons learned from targeting BCL-2 family members. Clin Cancer Res. 13(24):7264-7270 (2007).

Verma et al., Small interfering RNAs directed against beta-catenin inhibit the in vitro and in vivo growth of colon cancer cells. Clin Cancer Res. Apr. 2003;9(4):1291-300.

Viallet, et al. Tallimustine is inactive in patients with previously treated small cell lung cancer. A phase II trial of the National Cancer Institute of Canada Clinical Trials Group. Lung Cancer. Nov. 1996;15(3):367-73.

Voet D, Voet JG, Biochemistry, Second Edition, John Wiley & Sons, Inc., 1995, pp. 235-241.

Vu, et al. (2013). Discovery of RG7112: A Small-Molecule MDM2 Inhibitor in Clinical Development. ACS Med Chem Lett 4, 466-469.

Walensky et al., A stapled BID BH3 helix directly binds and activates BAX. (2006) Mol Cell 24:199-210.

Walensky, et al. Activation of apoptosis in vivo by a hydrocarbon-stapled BH3 helix. Science. 2004;305(5689):1466-1470.

Walker, et al. General method for the synthesis of cyclic peptidomimetic compounds. Tetrahedron Letters. 2001; 42(34):5801-5804.

Walter et al., Critical role for IL-13 in the development of allergen-induced airway hyperreactivity. J Immunol. Oct. 15, 2001;167(8):4668-75.

Wang, 4-Alkyl-2-trichloromethyloxazolidin-5-ones: Valuable Precursors to Enantiomerically Pure C- and N-Protected a-Alkyl Prolines. Synlett. 1999;1:33-36.

Wang, et al. (2011). Fine-tuning p53 activity through C-terminal modification significantly contributes to HSC homeostasis and mouse radiosensitivity. Genes Dev 25, 1426-1438.

(56) References Cited

OTHER PUBLICATIONS

Wang, et al. BID: a novel BH3 domain-only death agonist. Genes Dev. Nov. 15, 1996;10(22):2859-69.
Wang et al. Cell permeable Bcl-2 binding peptides: a chemical approach to apoptosis induction in tumor cells. Cancer Res. Mar. 15, 2000;60(6):1498-502.
Wang, et al. Click synthesis of small molecule probes for activity-based fingerprinting of matrix metalloproteases. Chem Commun (Camb). Sep. 28, 2006;(36):3783-5.
Wang et al. Enhanced metabolic stability and protein-binding properties of artificial alpha helices derived from a hydrogen-bond surrogate: application to Bcl-xL. Angew Chem Int Ed Engl. Oct. 14, 2005;44(40):6525-9.
Wang, et al. Evaluation of biologically relevant short alpha-helices stabilized by a main-chain hydrogen-bond surrogate. J Am Chem Soc. Jul. 19, 2006;128(28):9248-56.
Wang, et al. Inhibition of HIV-1 fusion 1-15 by hydrogen-bond-surrogate-based alpha helices. Angewandte Chemie International Edition. 2008; 47(10):1879-1882.
Wang et al., Inhibition of p53 degradation by Mdm2 acetylation. FEBS Lett. Mar. 12, 2004;561(1-3):195-201.
Wang, et al. Nucleation and stability of hydrogen-bond surrogate-based alpha-helices. Org Biomol Chem. Nov. 21, 2006;4(22):4074-81.
Wang et al., Recognition of a Protein Receptor with the Hydrogen Bond Surrogate-based Artificial Alpha-helices, American Chemical Society Meeting, San Diego (Mar. 2005) (poster).
Wang et al., Recognition of a Protein Receptor with the Hydrogen Bond Surrogate-based Artificial Alpha-helices, Chemical Biology Symposium, Hunter College (Jan. 2005) (poster).
Weaver et al.,Transition metal-catalyzed decarboxylative allylation and benzylation reactions.Chemical Rev. Mar. 9, 2011;111(3):1846-913.
Wei et al., Disorder and structure in the RabII binding domain of RabII family interacting protein 2. Biochemistry. Jan. 27, 2009;48(3):549-57. doi: 10.1021/bi8020197.
Wei, et al. tBID, a membrane-targeted death ligand, oligomerizes BAK to release cytochrome c. Genes Dev. Aug. 15, 2000;14(16):2060-71.
Wels, et al. Synthesis of a novel potent cyclic peptide MC4-ligand by ring-closing metathesis. Bioorg. Med. Chem. Lett. 2005; 13: 4221-4227.
Weng et al., Activating mutations of NOTCH1 in human T cell acute lymphoblastic leukemia. Science. Oct. 8, 2004;306(5694):269-71.
Weng et al., Growth suppression of pre-T acute lymphoblastic leukemia cells by inhibition of notch signaling. Mol Cell Biol. Jan. 2003;23(2):655-64.
Westhoff et al., Alterations of the Notch pathway in lung cancer. Proc Natl Acad Sci U S A. Dec. 29, 2009;106(52):22293-8. doi: 10.1073/pnas.0907781106. Epub Dec. 10, 2009.
Wikipedia the Free Encyclopedia. Willgerodt Rearrangement. Available at https://en.wikipedia.org/wiki/Willgerodt_rearrangement. Accessed on Feb. 12, 2013.
Wild et al., Peptides Corresponding to a Predictive α-Helical Domain of Human Immunodeficiency Virus Type 1 gp4I are Potent Inhibitors of Virus Infection, Proc. Nat'l Acad. Sci. USA 91:9770-9774 (1994).
Wilen et al., Strategies in Optical Resolution. Tetrahedron. 1977;33:2725-36.
Wilen, Tables of Resolving Agents and Optical Resolutions. E.L. Eliel, ed. Universtify of Notre Dame Press, Notre Dame, IN. 1972:268-98.
Williams and IM. Asymmetric Synthesis of Nonsubstituted and α,α-Disubstituted α-Amino Acids via Disatereoselective Glycine Enolate Alkylations. JACS. 1991;113:9276-9286.
Williams et al., Asymmetric synthesis of 2,6-diamino-6-(hydroxymethyl)pimelic acid: assignment of stereochemistry. J Am Chem Soc. 1991;113(18):6976-6981.
Wills-Karp et al., Interleukin-13: central mediator of allergic asthma. Science. Dec. 18, 1998;282(5397):2258-61.

Wills-Karp, Interleukin-13 in asthma pathogenesis. Immunol Rev. Dec. 2004;202:175-90.
Wills-Karp, The gene encoding interleukin-13: a susceptibility locus for asthma and related traits. Respir Res. 2000;1(1):19-23. Epub Jul. 17, 2000.
Wilson et al., Crystal structure of the CSL-Notch-Mastermind ternary complex bound to DNA. Cell. Mar. 10, 2006;124(5):985-96.
Wilson et al., The FIP3-RabII protein complex regulates recycling endosome targeting to the cleavage furrow during late cytokinesis. Mol Biol Cell. Feb. 2005;16(2):849-60. Epub Dec. 15, 2004.
Woon et al., Linking of 2-oxoglutarate and substrate binding sites enables potent and highly selective inhibition of JmjC histone demethylases. Angew Chem Int Ed Engl. Feb. 13, 2012;51(7):1631-4. doi: 10.1002/anie.201107833. Epub Jan. 12, 2012.
Wu et al., MAML1, a human homologue of *Drosophila* mastermind, is a transcriptional co-activator for NOTCH receptors. Nat Genet. Dec. 2000;26(4):484-9.
Wu, et al. Regiospecific Synthesis of 1,4,5-Trisubstituted-1,2,3-triazole via One-Pot Reaction Promoted by Copper(I) Salt. Synthesis. 2005(8): 1314-1318.
Wu, et al. Studies on New Strategies for the Synthesis of Oligomeric 1,2,3-Triazoles. Synlett 2006(4): 0645-0647.
Wu et al., Therapeutic antibody targeting of individual Notch receptors. Nature. Apr. 15, 2010;464(7291):1052-7. doi: 10.1038/nature08878.
Xi et al., Use of DNA and peptide nucleic acid molecular beacons for detection and quantification of rRNA in solution and in whole cells. Appl Environ Microbiol. Sep. 2003;69(9):5673-8.
Xing, et al. Crystal structure of a beta-catenin/axin complex suggests a mechanism for the beta-¬catenin destruction complex. Genes Dev. Nov. 15, 2003;17(22):2753-64. Epub Nov. 4, 2003.
Xiong, et al. (2010). Spontaneous tumorigenesis in mice overexpressing the p53-negative regulator Mdm4. Cancer Res 70, 7148-7154.
Yang, et al. Calculation of protein conformation from circular dichroism. Methods Enzymol. 1986;130:208-69.
Yang et al., Therapeutic dosing with anti-interleukin-13 monoclonal antibody inhibits asthma progression in mice. J Pharmacol Exp Ther. Apr. 2005;313(1):8-15. Epub Jan. 11, 2005.
Ye et al., Neurogenic phenotypes and altered Notch processing in *Drosophila presenilin* mutants. Nature. Apr. 8, 1999;398(6727):525-9.
Yee, et al. Efficient large-scale synthesis of BILN 2061, a potent HCV protease inhibitor, by a convergent approach based on ring-closing metathesis. J Org Chem. Sep. 15, 2006;71(19):7133-45.
Yin et al. Terphenyl-based Helical Mimetics That Disrupt the p53/HDM2 Interaction. Angew. Chem. Int. Ed. 44:2704-2707 (2005).
Yu, et al. Synthesis of macrocyclic natural products by catalyst-controlled stereoselective ring-closing metathesis. Nature. Nov. 2, 2011;479(7371):88-93. doi: 10.1038/nature10563.
Yu et al., The role of Axin2 in calvarial morphogenesis and craniosynostosis. Development. Apr. 2005; 132(8): 1995-2005.
Zamzami et al. The thiol crosslinking agent diamide overcomes the apoptosis-inhibitory effect of Bcl-2 by enforcing mitochondrial permeability transition. Oncogene. Feb. 26, 1998;16(8):1055-63.
Zeisig, et al. (2012). SnapShot: Acute myeloid leukemia. Cancer Cell 22, 698-698 e691.
Zhang, et al. 310 Helix versus alpha-helix: a molecular dynamics study of conformational preferences of Aib and Alanine. J. American Cancer Society. Dec. 1994; 116(26):11915-11921.
Zhang et al., A cell-penetrating helical peptide as a potential HIV-1 inhibitor. J Mol Biol. May 2, 2008;378(3):565-80. doi: 10.1016/j.jmb.2008.02.066. Epub Mar. 6, 2008.
Zhang, et al. A triazole-templated ring-closing metathesis for constructing novel fused and bridged triazoles. Chem Commun (Camb). Jun. 21, 2007;(23):2420-2.
Zhang, et al. Development of a High-throughput Fluorescence Polarization Assay for Bcl-xL. Anal. Biochem. 2002; 307:70-75.
Zhang, et al. Ruthenium-catalyzed cycloaddition of alkynes and organic azides. J Am Chem Soc. Nov. 23, 2005;127(46):15998-9.
Zhao, et al. (2010). p53 loss promotes acute myeloid leukemia by enabling aberrant self-renewal. Genes Dev 24, 1389-1402.

(56) References Cited

OTHER PUBLICATIONS

Zhao, et al. (2015). Small-molecule inhibitors of the MDM2-p53 protein-protein interaction (MDM2 Inhibitors) in clinical trials for cancer treatment. J Med Chem 58, 1038-1052.

Zhou, et al. Identification of ubiquitin target proteins using cell-based arrays. J Proteome Res. 2007; 6:4397-4406.

Zhou et al., Lymphoid enhancer factor 1 directs hair follicle patterning and epithelial cell fate. Genes Dev. Mar. 15, 1995;9(6):700-13.

Zhou et aL, Tyrosine kinase inhibitor STI-571/Gleevec down-regulates the beta-catenin signaling activity. Cancer Lett. Apr. 25, 2003;193(2):161-70.

Zimm & Bragg, Theory of the Phase Transition between Helix and Random Coil in Polypeptide Chains, J. Chem. Phys. 31(2):526-535 (1959).

Zor et aL, Solution structure of the KIX domain of CBP bound to the transactivation domain of c-Myb. J Mol Biol. Mar. 26, 2004;337(3):521-34.

Benito, et al. Bicyclic Organo-Peptides as Selective Carbohydrate Receptors: Design, Solid-phase Synthesis, and on-bead Binding Capability. QSAR & Combinatorial Science, 2004; 23:117-129.

Blaser, et al. The facile synthesis of a series of tryptophan derivatives. Tetrahedron Letters. vol. 49, Issue 17, Apr. 21, 2008, pp. 2795-2798.

Co-pending U.S. Appl. No. 15/917,054, filed on Mar. 9, 2018.
Co-pending U.S. Appl. No. 15/975,298, filed May 9, 2018.
Co-pending U.S. Appl. No. 15/982,700, filed May 17, 2018.
Co-pending U.S. Appl. No. 16/002,977, filed Jun. 7, 2018.
Co-pending U.S. Appl. No. 16/009,755, filed Jun. 15, 2018.
Co-pending U.S. Appl. No. 16/023,606, filed Jun. 29, 2018.
Lau, et al. Investigating peptide sequence variations for 'double-click' stapled p53 peptides. Org Biomol Chem. Jun. 28, 2014;12(24):4074-7.

Database: Genpept, Accession No. AAS47564.1, "mixed type I polyketide synthase/nonribosomal peptide synthetase [symbiont bacterium of Paederus fuscipes]", Submitted (Jun. 19, 2003).

Reenberg, et al. Specific Recognition of Disaccharides in Water by an Artificial Bicyclic Carbohydrate Receptor. European Journal of Org. Chem. 2007; 30:5003-5009.

Eliel, Stereochemistry of Carbon Compounds, McGraw-Hill, New York 1962.

EP15844140.2 Extended Search Report dated Jun. 6, 2018.
The RX list webpage for cytarabine, https://web.archive.org/web/20081113060948/https://www.rxlist.com/cytarabine-drug.htm, available Nov. 2008.

Timmerman, et al. Rapid and quantitative cyclization of multiple peptide loops onto synthetic scaffolds for structural mimicry of protein surfaces. Chembiochem. May 2005;6(5):821-4.

U.S. Appl. No. 14/460,848 Office Action dated Jun. 11, 2018.
U.S. Appl. No. 15/093,869 Notice of Allowance dated May 31, 2018.
U.S. Appl. No. 15/275,118 Office Action dated Jun. 1, 2018.
U.S. Appl. No. 14/864,801 Notice of Allowance dated May 21, 2018.
U.S. Appl. No. 15/256,130 Office Action dated Jul. 16, 2018.
Co-pending U.S. Appl. No. 16/050,380, filed Jul. 31, 2018.
Co-pending U.S. Appl. No. 16/051,744, filed Aug. 1, 2018.
Co-pending U.S. Appl. No. 16/053,015, filed Aug. 2, 2018.
Co-pending U.S. Appl. No. 16/126,300, filed Sep. 10, 2018.
U.S. Appl. No. 15/240,505 Office Action dated Oct. 3, 2018.
U.S. Appl. No. 14/864,801 Office Action dated Aug. 27, 2018.
U.S. Appl. No. 15/352,911 Notice of Allowance dated Sep. 26, 2018.
U.S. Appl. No. 15/592,517 Office Action dated Sep. 27, 2018.

* cited by examiner

SP refers to cross-linked peptidomimetic macrocycles, for example to Aileron test peptide-1.

2(a) Samples of F1 and F2 10 min after dissolving.

F1　　　　　　　　　　F2

2(b) Samples of F1 and F2 30 min after dissolving.

F1　　　　　　　　　　F2

PEPTIDOMIMETIC MACROCYCLES AND FORMULATIONS THEREOF

CROSS REFERENCE

This application claims priority to U.S. Provisional Application No. 62/054,842, filed Sep. 24, 2014, which is incorporated herein by reference in its entirety.

SEQUENCE LISTING

The instant application contains a Sequence Listing which has been submitted electronically in ASCII format and is hereby incorporated by reference in its entirety. Said ASCII copy, created on Jun. 8, 2016, is named 35224-803.201_SL.txt and is 1,382,262 bytes in size.

BACKGROUND OF THE DISCLOSURE

The human transcription factor protein p53 induces cell cycle arrest and apoptosis in response to DNA damage and cellular stress, and thereby plays a critical role in protecting cells from malignant transformation. The E3 ubiquitin ligase MDM2 (also known as HDM2 or human double minute 2) negatively regulates p53 function through a direct binding interaction that neutralizes the p53 transactivation activity, leads to export from the nucleus of p53 protein, and targets p53 for degradation via the ubiquitylation-proteasomal pathway. Loss of p53 activity, either by deletion, mutation, or MDM2 overexpression, is the most common defect in human cancers. Tumors that express wild type p53 are vulnerable to pharmacologic agents that stabilize or increase the concentration of active p53. In this context, inhibition of the activities of MDM2 has emerged as a validated approach to restore p53 activity and resensitize cancer cells to apoptosis in vitro and in vivo. MDMX (also known as MDM4, HDM4 or human double minute 4) has more recently been identified as a similar negative regulator of p53, and studies have revealed significant structural homology between the p53 binding interfaces of MDM2 and MDMX. MDMX has also been observed to be overexpressed in human tumors. The p53-MDM2 and p53-MDMX protein-protein interactions are mediated by the same 15-residue alpha-helical transactivation domain of p53, which inserts into hydrophobic clefts on the surface of MDM2 and MDMX. Three residues within this domain of wild type p53 (F19, W23, and L26) are essential for binding to MDM2 and MDMX.

There remains a considerable need for compounds capable of binding to and modulating the activity of p53, MDM2 and/or MDMX. Provided herein are aqueous pharmaceutical formulations comprising p53-based peptidomimetic macrocycles that modulate an activity of p53. Also provided herein are aqueous pharmaceutical formulations comprising p53-based peptidomimetic macrocycles that inhibit the interactions between p53, MDM2 and/or MDMX proteins. Further, provided herein are aqueous pharmaceutical formulations comprising p53-based peptidomimetic macrocycles that can be used for treating diseases including but not limited to cancer and other hyperproliferative diseases.

SUMMARY OF THE DISCLOSURE

In one aspect, the disclosure provides an aqueous pharmaceutical formulation comprising a peptidomimetic macrocycle that binds to MDM2 and/or MDMX proteins or a pharmaceutically acceptable salt thereof, a buffering agent, a tonicity agent, and a stabilizing agent wherein the amount of the peptidomimetic macrocycle in the aqueous pharmaceutical formulation is equal to or greater than 15 mg/mL and wherein the aqueous pharmaceutical formulation comprises less than 2% w/v of any micelle forming agent. The micelle forming agent can be solutol-HS-15. In some examples, the peptidomimetic macrocycle forms a micelle in absence of a surfactant.

In another aspect, the disclosure provides an aqueous pharmaceutical formulation comprising (i) a peptidomimetic macrocycle or a pharmaceutically acceptable salt thereof, wherein the amount of the peptidomimetic macrocycle in the aqueous pharmaceutical formulation is equal to or greater than 15 mg/mL; (ii) a buffering agent; (iii) a stabilizing agent; and (iv) a tonicity agent, wherein the molar ratio of the peptidomimetic macrocycle to the buffering agent is in the range of 0.01-2.5.

In another aspect, the disclosure provides an aqueous pharmaceutical formulation comprising a peptidomimetic macrocycle that binds to a target protein with a $K_D$ value of $1 \times 10^{-7}$ M or less, or a pharmaceutically acceptable salt thereof, a buffering agent, a tonicity agent, and a stabilizing agent wherein the amount of the peptidomimetic macrocycle in the aqueous pharmaceutical formulation is equal to or greater than 15 mg/mL and wherein the aqueous pharmaceutical formulation comprises less than 2% w/v of any micelle forming agent, wherein the peptidomimetic macrocycle or pharmaceutically acceptable salt thereof has: (a) a length value of from 10 to 24 amino acids, (b) a von Heijne value of from 2 to 10, (c) a net charge of from −4 to +2, (d) a percent alanine content of from 15% to 50%, (e) or any combination of (a)-(d).

In some embodiments, the peptidomimetic macrocycle or pharmaceutically acceptable salt thereof is not precipitated in the formulation. In some embodiments, an aqueous solubility of the peptidomimetic macrocycle is determined by evaluating the turbidity of a solution comprising the peptidomimetic macrocycle. In some embodiments, the peptidomimetic macrocycle or pharmaceutically acceptable salt thereof has an amphipathicity that falls in a range that is optimal for cell permeability.

In some embodiments, the peptidomimetic macrocycle or pharmaceutically acceptable salt thereof has a length value of from 14 to 20 amino acids. In some embodiments, the peptidomimetic macrocycle or pharmaceutically acceptable salt thereof has a von Heijne value of from 2 to 9. In some embodiments, the peptidomimetic macrocycle or pharmaceutically acceptable salt thereof has a von Heijne value of from 3 to 8. In some embodiments, the peptidomimetic macrocycle or pharmaceutically acceptable salt thereof has a von Heijne value of from 4 to 7. In some embodiments, the peptidomimetic macrocycle or pharmaceutically acceptable salt thereof has a net charge of from −2 to 0. In some embodiments, the peptidomimetic macrocycle or pharmaceutically acceptable salt thereof has a percent alanine content of from 15% to 40%. In some embodiments, the peptidomimetic macrocycle or pharmaceutically acceptable salt thereof has a percent alanine content of from 20% to 40%. In some embodiments, the peptidomimetic macrocycle or pharmaceutically acceptable salt thereof has a percent alanine content of from 25% to 40%. In some embodiments, the peptidomimetic macrocycle or pharmaceutically acceptable salt thereof has a length value of from 14 to 20 amino acids, a von Heijne value of from 4 to 7, a net charge of from −2 to 0, and a percent alanine content of from 25% to 40%. In some embodiments, the peptidomimetic macrocycle or pharmaceutically acceptable salt thereof is soluble, does not have off-target effects, or a combination thereof.

In some embodiments, the peptidomimetic macrocycle or pharmaceutically acceptable salt thereof comprises a first C-terminal amino acid that is hydrophobic. In some embodiments, the peptidomimetic macrocycle or pharmaceutically acceptable salt thereof comprises a second C-terminal amino acid that is hydrophobic. In some embodiments, the peptidomimetic macrocycle or pharmaceutically acceptable salt thereof comprises a third C-terminal amino acid that is hydrophobic. In some embodiments, the peptidomimetic macrocycle or pharmaceutically acceptable salt thereof comprises a fourth C-terminal amino acid that is hydrophobic. In some embodiments, the peptidomimetic macrocycle or pharmaceutically acceptable salt thereof comprises a fifth C-terminal amino acid that is hydrophobic. In some embodiments, the peptidomimetic macrocycle or pharmaceutically acceptable salt thereof comprises a sixth C-terminal amino acid that is hydrophobic.

In some embodiments, the first amino acid connected to the crosslinker is N-terminal to the second amino acid connected to the crosslinker, and wherein the peptidomimetic macrocycle or pharmaceutically acceptable salt thereof comprises 1, 2, 3, 4, 5, 6, 7, or 8 amino acids that are C-terminal to the second amino acid connected to the crosslinker.

In some embodiments, the first amino acid connected to the crosslinker is N-terminal to the second amino acid connected to the crosslinker, and wherein the peptidomimetic macrocycle or pharmaceutically acceptable salt thereof comprises 1, 2, 3, 4, 5, or 6 hydrophobic amino acids that are C-terminal to the second amino acid connected to the crosslinker.

In some embodiments, the first amino acid connected to the crosslinker is N-terminal to the second amino acid connected to the crosslinker, and wherein the peptidomimetic macrocycle or pharmaceutically acceptable salt thereof comprises 1, 2, or 3 glutamines that are C-terminal to the second amino acid connected to the crosslinker.

In some embodiments, the amino acid that is hydrophobic is a small hydrophobic amino acid. In some embodiments, the amino acid that is hydrophobic is an alanine, a D-alanine, or an Aib.

In some embodiments, the peptidomimetic macrocycle or pharmaceutically acceptable salt thereof is a helical polypeptide. In some embodiments, the peptidomimetic macrocycle or pharmaceutically acceptable salt thereof comprises an α-helix. In some embodiments, the peptidomimetic macrocycle or pharmaceutically acceptable salt thereof comprises an amphipathic α-helix.

In some embodiments, the first amino acid connected to the crosslinker or the second amino acid connected to the crosslinker is an α,α-disubstituted amino acid. In some embodiments, the first amino acid connected to the crosslinker and the second amino acid connected to the crosslinker are α,α-disubstituted amino acids. In some embodiments, the first amino acid connected to the crosslinker and the second amino acid connected to the crosslinker are separated by two amino acids. In some embodiments, the first amino acid connected to the crosslinker and the second amino acid connected to the crosslinker are separated by three amino acids. In some embodiments, the first amino acid connected to the crosslinker and the second amino acid connected to the crosslinker are separated by six amino acids. In some embodiments, the crosslinker spans 1 turn of an α-helix of the peptidomimetic macrocycle. In some embodiments, the crosslinker spans 2 turns of an α-helix of the peptidomimetic macrocycle. In some embodiments, the length of the crosslinker is from about 5 Å to about 9 Å per turn of an α-helix of the peptidomimetic macrocycle. In some embodiments, the peptidomimetic macrocycle or pharmaceutically acceptable salt thereof provides a therapeutic effect. In some embodiments, an ability of the peptidomimetic macrocycle or pharmaceutically acceptable salt thereof to penetrate cell membranes by an energy-dependent process is improved relative to a corresponding uncrosslinked peptidomimetic macrocycle. In some embodiments, the ability of the peptidomimetic macrocycle or pharmaceutically acceptable salt thereof to penetrate cell membranes by an energy-independent process is improved relative to a corresponding uncrosslinked peptidomimetic macrocycle. In some embodiments, the energy-dependent process is primary active transport, secondary transport, endocytosis, or a combination thereof. In some embodiments, the energy-dependent process is active transport. In some embodiments, the energy-independent process is passive diffusion, facilitated diffusion, filtration, or a combination thereof. In some embodiments, the energy-independent process is passive transport.

In some embodiments, the peptidomimetic macrocycle or pharmaceutically acceptable salt thereof binds to HDM2 with a $K_D$ value of $1 \times 10^{-7}$ M or less. In some embodiments, the peptidomimetic macrocycle or pharmaceutically acceptable salt thereof binds to HDM2 or HDM4 with a $K_D$ value of $1 \times 10^{-7}$ M or less. In some embodiments, the peptidomimetic macrocycle or pharmaceutically acceptable salt thereof binds to HDM4 with a $K_D$ value of $1 \times 10^{-7}$ M or less. In some embodiments, the peptidomimetic macrocycle or pharmaceutically acceptable salt thereof binds to a PB1 peptide binding site of a PA protein with a $K_D$ value of $1 \times 10^{-7}$ M or less. In some embodiments, the peptidomimetic macrocycle or pharmaceutically acceptable salt thereof binds to a PB2 peptide binding site of a PB1 protein with a $K_D$ value of $1 \times 10^{-7}$ M or less. In some embodiments, the peptidomimetic macrocycle or pharmaceutically acceptable salt thereof binds to viral polymerase, for example, a RNA-dependent RNA polymerase with a $K_D$ value of $1 \times 10^{-7}$ M or less. In some embodiments, the peptidomimetic macrocycle or pharmaceutically acceptable salt thereof inhibits an influenza RNA-dependent RNA polymerase. In some embodiments, the virus is influenza virus. In some embodiments, the peptidomimetic macrocycle is capable of competing with the binding of a peptide of the sequence MDVNPTLL-FLKVPAQ (SEQ ID NO: 1) or MERIKELRNLM (SEQ ID NO: 2) to the viral RNA-dependent RNA polymerase. In some embodiments, the peptidomimetic macrocycle or pharmaceutically acceptable salt thereof binds to MCL-1, BCL-$X_L$, BCL-2, or a combination thereof with a $K_D$ value of $1 \times 10^{-7}$ M or less. In some embodiments, the peptidomimetic macrocycle or pharmaceutically acceptable salt thereof binds to MCL-1 with a $K_D$ value of $1 \times 10^{-7}$ M or less. In some embodiments, the peptidomimetic macrocycle or pharmaceutically acceptable salt thereof binds to BCL-$X_L$ with a $K_D$ value of $1 \times 10^{-7}$ M or less. In some embodiments, the peptidomimetic macrocycle or pharmaceutically acceptable salt thereof binds to BCL-2 with a $K_D$ value of $1 \times 10^{-7}$ M or less.

In some embodiments, the peptidomimetic macrocycle or pharmaceutically acceptable salt thereof has an $IC_{50}$ value of 100 nM or less to a target protein. In some embodiments, the peptidomimetic macrocycle or pharmaceutically acceptable salt thereof has an $EC_{50}$ value of 100 μM or less.

In some embodiments, the peptidomimetic macrocycle or pharmaceutically acceptable salt thereof has an $IC_{50}$ value of 10 nM or less to a target protein. In some embodiments, the peptidomimetic macrocycle or pharmaceutically acceptable salt thereof has an $EC_{50}$ value of 10 µM or less. In some embodiments, the peptidomimetic macrocycle or pharmaceutically acceptable salt thereof has an $IC_{50}$ value of 1 nM or less to a target protein. In some embodiments, the peptidomimetic macrocycle or pharmaceutically acceptable salt thereof has an $EC_{50}$ value of 1 µM or less.

In some embodiments, the peptidomimetic macrocycle or pharmaceutically acceptable salt thereof has a penetration efficiency value of 100 or less. In some embodiments, the peptidomimetic macrocycle or pharmaceutically acceptable salt thereof has a penetration efficiency value of 10 or less. In some embodiments, the peptidomimetic macrocycle or pharmaceutically acceptable salt thereof has a penetration efficiency value of 1 or less.

In some embodiments, the peptidomimetic macrocycle penetrates cell membranes by an energy-dependent process and binds to an intracellular target with a $K_D$ value of $1\times10^{-7}$ M or less. In some embodiments, the energy-dependent process comprises primary active transport, secondary transport, or endocytosis. In some embodiments, the energy-dependent process comprises active transport. In some embodiments, the peptidomimetic macrocycle penetrates cell membranes by an energy-independent process and binds to an intracellular target with a $K_D$ value of $1\times10^{-7}$ M or less. In some embodiments, the energy-independent process comprises passive diffusion, facilitated diffusion, or filtration. In some embodiments, the energy-independent process comprises passive transport.

In some embodiments, the amount of the buffering agent in the aqueous pharmaceutical formulations of the disclosure is 0.001-10% w/v, the stabilizing agent in the aqueous pharmaceutical formulations of the disclosure is 0.001-10% w/v and, the amount of the tonicity agent in the aqueous pharmaceutical formulations of the disclosure 1.0-10% w/v.

The pharmaceutically acceptable salt of the peptidomimetic macrocycle can be a sodium salt. In some examples, the pharmaceutically acceptable salt of the peptidomimetic macrocycle can be a potassium, lithium, calcium, zinc or magnesium salt.

Any suitable amount of the peptidomimetic macrocycle can be used in the aqueous pharmaceutical formulations of the disclosure. In some examples, the amount of the peptidomimetic macrocycle present in the aqueous pharmaceutical formulation can be from about 0.1-10% w/v. For example, the amount of the peptidomimetic macrocycle present in the aqueous pharmaceutical formulation can be about 1% w/v, 1.5% w/v, or 2% w/v. In some examples, the concentration of the peptidomimetic macrocycle present in the aqueous pharmaceutical formulation is about 15-100 mg/mL. In some examples, the concentration of the peptidomimetic macrocycle present in the aqueous pharmaceutical formulation is about 15-50 mg/mL. In some examples, the concentration of the peptidomimetic macrocycle present in the aqueous pharmaceutical formulation is about 15, 20, 25, or 50 mg/mL.

Any suitable buffering agent can be used in the aqueous pharmaceutical formulations described herein. In some examples, the buffering agent is selected from a group consisting of ammonia solution, calcium carbonate, tribasic calcium phosphate, citric acid dihydrate, citric acid monohydrate, dibasic sodium phosphate, diethanolamine, malic acid, monobasic sodium phosphate, monoethanolamine, monosodium glutamate, phosphoric acid, phosphate-citrate buffer (dibasic sodium phosphate and citric acid), potassium citrate, sodium acetate, sodium bicarbonate, sodium borate, sodium citrate dehydrate, sodium hydroxide, sodium lactate, sodium carbonate, and triethanolamine (tris(hydroxymethyl) aminomethane). In some examples, the buffering agent is a phosphate buffer. In some examples, the buffering agent is selected from a group consisting of phosphoric acid, dibasic sodium phosphate, monobasic sodium phosphate or a mixture thereof. In some examples, the buffering agent is 20 mM phosphate buffer The amount of the buffering agent in the aqueous pharmaceutical formulations of the disclosure can be from about 0.001-10% w/v. In some examples, the amount of the buffering agent in the aqueous pharmaceutical formulations of the disclosure is from about 0.01-10% w/v. In some examples, the amount of the buffering agent in the aqueous pharmaceutical formulations of the disclosure is from about 0.01-5% w/v. In some examples, the amount of the buffering agent in the aqueous pharmaceutical formulations of the disclosure is from about 0.01-1% w/v. In some examples, the amount of the buffering agent present in the aqueous pharmaceutical formulations of the disclosure is about 0.2% w/v.

The stabilizing agent in the aqueous pharmaceutical formulations of the disclosure can be a non-ionic stabilizing agent. In some examples, the stabilizing agent is a fatty acid ester. In some examples, the stabilizing agent can be a surfactant. In some for examples, the stabilizing agent is a non-ionic surfactant. In some for examples, the stabilizing agent is an anti-oxidant. In some examples the stabilizing agent can be selected from a group consisting of polyoxyethylene glycol alkyl ethers, polyoxypropylene glycol alkyl ethers, glucoside alkyl ethers, polyoxyethylene glycol octylphenol ethers, polyoxyethylene glycol alkylphenol ethers, glycerol alkyl esters, polyoxyethylene glycol sorbitan alkyl esters, sorbitan alkyl esters, cocamide MEA, cocamide DEA, dodecyldimethylamine oxide, block copolymers of polyethylene glycol and polypropylene glycol, and polyethoxylated tallow amine. In some examples, the stabilizing agent can be a polyoxyethylene sorbitan fatty acid ester. In some examples, stabilizing agent can be polysorbate 20, polysorbate 21, polysorbate 40, polysorbate 60, polysorbate 61, polysorbate 65, polysorbate 80, polysorbate 81, polysorbate 85 or polysorbate 120. In some examples, the stabilizing agent can be polysorbate 20.

The amount of the stabilizing agent present in the aqueous pharmaceutical formulation is from about 0.001-10% w/v, for example from about 0.01-0.05% w/v. In some examples, the amount of the stabilizing agent present in the aqueous pharmaceutical formulations is about 0.03% w/v. In some examples, the aqueous pharmaceutical formulations comprise 250-350 ppm polysorbate 20. The aqueous pharmaceutical formulation of the disclosure can be a solution. In some examples, the aqueous pharmaceutical formulations can be sterile. In some examples, the aqueous pharmaceutical formulations can be colorless. In some examples, the aqueous pharmaceutical formulations can be a frozen solution. In some examples, the aqueous pharmaceutical formulation can be refrigerated solution.

In some examples, the aqueous pharmaceutical formulations can be particulate-free. In some examples, the aqueous pharmaceutical formulations comprise less than about 6,000 particles of size ≥10 µm in about 5 mL of the aqueous formulation. In some examples, the aqueous pharmaceutical formulations comprise less than about 600 particles of size ≥25 µm in about 5 mL of the aqueous formulation.

In some examples, the aqueous pharmaceutical formulations are dissolved into a diluent prior to administration into a subject. The diluent can be water for injection. In some examples, thee diluent can be solution of dextrose in water.

The amount of the diluent can be from about 50-99% w/v. In some examples, the amount of the diluent can be about 90% w/v.

In some examples, the tonicity agent in the aqueous pharmaceutical formulations of the disclosure can be a non-ionic tonicity agent. In some examples, the tonicity agent can be a sugar or a sugar alcohol. In some examples, the tonicity agent can be a mono- or a disaccharide. In some cases, the tonicity agent can be selected from a groups consisting of glucose, fructose, galactose, sucrose, lactose, maltose, trehalose, and mixtures thereof. In some examples, the tonicity agent can be mannitol, glycerin, or a combination thereof. In some examples the tonicity agent can be D-trehalose.

The amount of the tonicity agent present in the aqueous pharmaceutical formulations can be from about 1-15% w/v. In some examples, the amount of the tonicity agent present in the aqueous pharmaceutical formulations can be about 8% w/v. The concentration of the tonicity agent can be from about 200-300 mM. In some examples, the concentration of the tonicity agent is 240 mM.

The pH of the aqueous pharmaceutical formulations of the disclosure can be from about 4.0-9.0. In some examples the pH of the aqueous pharmaceutical formulations of the disclosure is from about 4.5-8.5. In some examples the pH of the aqueous pharmaceutical formulations of the disclosure is from about 5.0-8.0. In some examples the pH of the aqueous pharmaceutical formulations of the disclosure is from about 5.5-7.5. In some examples the pH of the aqueous pharmaceutical formulations of the disclosure is from about 7.0-7.5.

The aqueous pharmaceutical formulations of the disclosure can be stable for at least two years at a temperature of about $-20°$ C.$-25°$ C. In some examples, the aqueous pharmaceutical formulations can be stable for at least one year at a temperature of about $-20°$ C.$-25°$ C. In some examples, the aqueous pharmaceutical formulations can be stable for at least 6 months at a temperature of about $-20°$ C.$-25°$ C. In some examples, the aqueous pharmaceutical formulations can be stable for at least 3 months at a temperature of about $-20°$ C.$-25°$ C. In some examples, the aqueous pharmaceutical formulations can be stable for at least 3 months at a temperature of about $45°$ C. In some examples, the aqueous pharmaceutical formulations can be stable for at least 6 months at a temperature of about $45°$ C. In some examples, the aqueous pharmaceutical formulations can be stable for at least 3 weeks at a temperature of about $75°$ C. In some examples, the aqueous pharmaceutical formulations can be stable for at least 1.5 weeks at a temperature of about $75°$ C.

In some examples, the aqueous pharmaceutical formulations upon storage for 24 months at from about $2°$ C.$-8°$ C. can comprise at least 95% of the initial amount of the peptidomimetic macrocycle. In some examples, the aqueous pharmaceutical formulations upon storage for 12 months at from about $2°$ C.$-8°$ C. can comprise at least 95% of the initial amount of the peptidomimetic macrocycle. In some examples, the aqueous pharmaceutical formulations upon storage for 6 months at from about $2°$ C.$-8°$ C. can comprise at least 95% of the initial amount of the peptidomimetic macrocycle. In some cases, the aqueous pharmaceutical formulations upon storage for 3 months at from about $2°$ C.$-8°$ C. can comprise at least 95% of the initial amount of the peptidomimetic macrocycle.

The osmolality of the aqueous pharmaceutical formulations of the disclosure can be from about 100-600 milliosmoles per kilogram, for example from about 220-400 milliosmoles per kilogram.

The endotoxin level of the aqueous pharmaceutical formulations of the disclosure can be at most 2.0, 4.0, 6.0, 8.0 or 10 $EU/mL^2$. In some examples, the endotoxin level of the aqueous pharmaceutical formulations can be at most 4.5 $EU/mL^2$.

The aqueous pharmaceutical formulations of the disclosure can be contained in a container. The container can be a single use container or a multi-use container. In some examples, the container can be a glass vial. In some examples, the container is a pre-filled syringe to be used alone or in an injection device. In some examples, the container is a cartridge for a pen injection system, or a glass ampoule. In some examples, the container is a 20 mL, 10 mL, or a 5 mL glass serum vial. The glass vial can comprise borosilicate glass or polycarbonate. The container can comprise stopper and/or cap. The stopper can be a rubber stopper. The container can comprise a seal for example an aluminum seal.

The aqueous pharmaceutical formulations of the disclosure can be prepared by adding the peptidomimetic macrocycle or a pharmaceutically acceptable salt thereof to water or an aqueous solution, wherein the peptidomimetic macrocycle is capable of binding to the MDM2 and/or MDMX proteins. The pharmaceutically acceptable salt can be a sodium salt, potassium salt or calcium salt. In some examples, the aqueous pharmaceutical formulations can be prepared by dissolving a sodium salt of the peptidomimetic macrocycle in water. The method can further comprise adding a buffering agent and a stabilizing agent.

The aqueous pharmaceutical formulations of the disclosure can be suitable for administration to a subject without reconstitution or dilution. In some examples, the aqueous pharmaceutical formulations can require reconstitution prior to administration to a subject. Reconstitution can involve dilution with an aqueous solution, for example with a solution of dextrose in water.

In some embodiments, the micelle forming agent in solutol-HS-15. In some embodiments, the peptidomimetic macrocycle forms a micelle in absence of a surfactant. In some embodiments, the the aqueous pharmaceutical formulation does not form micelle.

The aqueous pharmaceutical formulations of the disclosure can further comprise a preservative. The preservative can be selected from a group consisting of benzalkonium chloride, EDTA and combination thereof. In some examples, the preservative can be selected from a group consisting of phenol, meta-cresol and combination thereof.

The aqueous pharmaceutical formulations of the disclosure can further comprise a co-solvent. The co-solvent can be selected from a group consisting of dimethyl sulfoxide (DMSO), N-methylpyrrolidone (NMP), dimethylacetamide (DMA) and combinations thereof.

The molecular weight of the peptidomimetic macrocycle can be in the range of 1800-2000 D. In some examples, the peptidomimetic macrocycle has an observed mass (m/e) in the range of 900-1000 D.

In another aspect the disclosure provides an aqueous pharmaceutical formulation comprising a peptidomimetic macrocycle that binds to MDM2 and/or MDMX proteins or a pharmaceutically acceptable salt thereof, phosphate buffering agent, D-trehalose, and polysorbate 20, wherein the peptidomimetic macrocycle comprises an amino acid sequence which is at least about 60%, 65%, 70%, 75%, 80%, 85%, 90%, 95% identical to an amino acid sequence in any of Table 1, Table 1a, Table 1b, and Table 1c, In some examples, the amount of the peptidomimetic macrocycle in the aqueous pharmaceutical formulation can be equal to or greater than 15 mg/mL. In some examples, the amount of D-trehalose in the aqueous pharmaceutical formulations can be about 8% w/v. The amount of polysorbate 20 in the aqueous pharmaceutical formulations can be about 0.03% w/v. In some examples, the aqueous pharmaceutical formulations comprise less than 2% w/v of any micelle forming agent.

The peptidomimetic macrocycle in the aqueous pharmaceutical formulations can comprise an amino acid sequence which is at least about 60%, 65%, 70%, 75%, 80%, 85%, 90%, 95% identical to an amino acid sequence in any of Table 1, Table 1a, Table 1b, and Table 1c, and wherein the peptidomimetic macrocycle has the formula:

Formula (I)

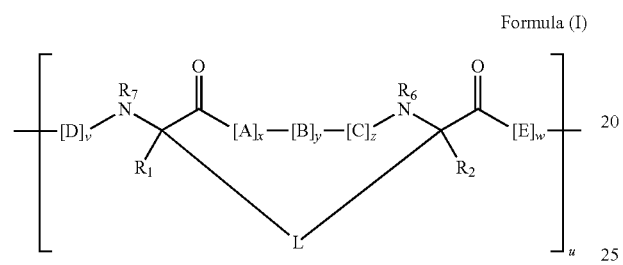

wherein:
each A, C, and D is independently an amino acid;
each B is independently an amino acid,

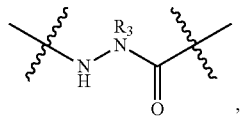

[—NH-L$_3$-CO—], [—NH-L$_3$-SO$_2$—], or [—NH-L$_3$-];
each E is independently an amino acid selected from the group consisting of Ala (alanine), D-Ala (D-alanine), Aib (α-aminoisobutyric acid), Sar (N-methyl glycine), and Ser (serine);
each R$_1$ and R$_2$ is independently —H, alkyl, alkenyl, alkynyl, arylalkyl, cycloalkyl, cycloalkylalkyl, heteroalkyl, or heterocycloalkyl, unsubstituted or substituted with halo; or forms a macrocycle-forming linker L' connected to the alpha position of one of said D or E amino acids;
each R$_3$ independently is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with R$_5$;
each L and L' is independently a macrocycle-forming linker;
each L$_3$ is independently alkylene, alkenylene, alkynylene, heteroalkylene, cycloalkylene, heterocycloalkylene, cycloarylene, heterocycloarylene, or [—R$_4$—K—R$_4$-]$_n$, each being optionally substituted with R$_5$;
each R$_4$ is independently alkylene, alkenylene, alkynylene, heteroalkylene, cycloalkylene, heterocycloalkylene, arylene, or heteroarylene;
each K is independently O, S, SO, SO$_2$, CO, CO$_2$, or CONR$_3$;
each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;
each R$_6$ is independently —H, alkyl, alkenyl, alkynyl, arylalkyl, cycloalkylalkyl, heterocycloalkyl, a fluorescent moiety, a radioisotope or a therapeutic agent;

each R$_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with a D residue;
each R$_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with an E residue;
each v is independently an integer from 1-1000;
each w is independently an integer from 3-1000;
u is an integer from 1-10;
each x, y and z is independently an integer from 0-10; and
each n is independently an integer from 1-5.

In some embodiments, the peptidomimetic macrocycle has formula:

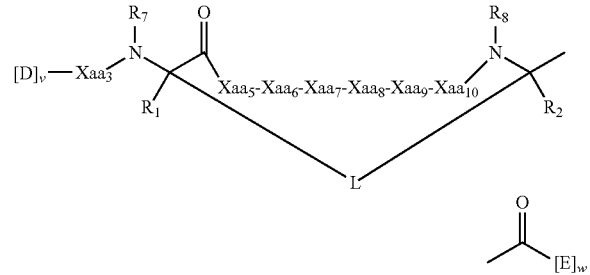

wherein:
each of Xaa$_3$, Xaa$_5$, Xaa$_6$, Xaa$_7$, Xaa$_8$, Xaa$_9$, and Xaa$_{10}$ is individually an amino acid, wherein at least three of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-His$_5$-Tyr$_6$-Trp$_7$-Ala$_8$-Gln$_9$-Leu$_{10}$-X$_{11}$-Ser$_{12}$ (SEQ ID NO: 3) or Phe$_3$-X$_4$-Glu$_5$-Tyr$_6$-Trp$_7$-Ala$_8$-Gln$_9$-Leu$_{10}$/Cba$_{10}$-X$_{11}$-Ala$_{12}$ (SEQ ID NO: 4), where each X is an amino acid;
each D and E is independently an amino acid;
each R$_1$ and R$_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of R$_1$ and R$_2$ forms a macrocycle-forming linker L' connected to the alpha position of one of said D or E amino acids;
each L or L' is independently a macrocycle-forming linker;
each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;
each R$_6$ is independently —H, alkyl, alkenyl, alkynyl, arylalkyl, cycloalkylalkyl, heterocycloalkyl, a fluorescent moiety, a radioisotope or a therapeutic agent;
R$_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with a D residue;
R$_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with an E residue;
v is an integer from 1-1000; and
w is an integer from 0-1000.

In some examples, at least one of the macrocycle-forming linker in the Formulas provided herein has a formula -$L_1$-L2-, wherein $L_1$ and $L_2$ are independently alkylene, alkenylene, alkynylene, heteroalkylene, cycloalkylene, heterocycloalkylene, cycloarylene, heterocycloarylene, or [—$R_4$—K—$R_4$-$]_n$, each being optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$; and each $R_3$ independently is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each n is independently an integer from 1-5.

In some embodiments w is an integer from 3-1000, for example 3-500, 3-200, 3-100, 3-50, 3-30, 3-20, or 3-10. In some examples, $Xaa_5$ is Glu or an amino acid analog thereof. In some examples each E is independently an amino acid selected from Ala (alanine), D-Ala (D-alanine), Aib (α-aminoisobutyric acid), Sar (N-methyl glycine), and Ser (serine). In some examples, $[D]_v$ is -$Leu_1$-$Thr_2$. In some examples, w is 3-6. In some examples, w is 6-10. In some examples, w is 6. In some examples, v is 1-10. In some examples, v is 2-10. In some examples, v is 2-5. In some examples, v is 2.

In some examples, $L_1$ and $L_2$ in the Formulas above are independently alkylene, alkenylene, alkynylene, heteroalkylene, cycloalkylene, heterocycloalkylene, cycloarylene, or heterocycloarylene, each being optionally substituted with $R_5$. In some examples, $L_1$ and $L_2$ are independently alkylene or alkenylene. In some examples, L is alkylene, alkenylene, or alkynylene. In some examples, L is alkylene. In some examples, L is $C_3$-$C_{16}$ alkylene. In some examples, L is $C_{10}$-$C_{14}$ alkylene.

In some examples, $R_1$ and $R_2$ in the Formulas above are independently —H, alkyl, alkenyl, alkynyl, arylalkyl, cycloalkyl, cycloalkylalkyl, heteroalkyl, or heterocycloalkyl, unsubstituted or substituted with halo-. In some examples, $R_1$ and $R_2$ are H. In some examples, $R_1$ and $R_2$ are independently alkyl. In some examples, $R_1$ and $R_2$ are methyl.

In some examples, x+y+z in the Formulas here is 6.

In some examples, in the Formulas here, u is 1.

In some examples, each E is Ser or Ala or an analog thereof.

In some examples, the aqueous pharmaceutical formulations comprise at least one amino acid which is an amino acid analog.

In some examples, the peptidomimetic macrocycle in the aqueous pharmaceutical formulations is a peptidomimetic macrocycle shown in Table 1c.

In another aspect, the disclosure provides a method of treating cancer in a subject, the method comprising administering to the subject a therapeutically effective amount of an aqueous pharmaceutical formulation of the disclosure.

In another aspect, the disclosure provides a method of treating cancer in a subject comprising administering to the subject an aqueous pharmaceutical formulation a peptidomimetic macrocycle peptidomimetic macrocycle that is capable of binding to the MDM2 and/or MDMX proteins and wherein the amount of the peptidomimetic macrocycle in the aqueous pharmaceutical formulation is greater than 15 mg/mL and wherein the aqueous pharmaceutical formulation contains less than 2% w/v of any micelle forming agent.

The aqueous pharmaceutical formulation can further comprise a buffering agent, a stabilizing agent, and/or tonicity agent.

The cancer can be selected from the group consisting of head and neck cancer, melanoma, lung cancer, breast cancer, and glioma. In some examples, the cancer is selected from a group consisting of bladder cancer, bone cancer, breast cancer, cervical cancer, CNS cancer, colon cancer, ocular tumor, renal cancer, liver cancer, lung cancer, pancreatic cancer, choriocarcinoma (tumor of the placenta), prostate cancer, sarcoma, skin cancer, soft tissue cancer, gastric cancer, gall bladder cancer, biliary cancer, renal cancer, neoblastoma, or neuroendocrine cancer.

In another aspect, the disclosure provides a method of modulating the activity of p53 and/or MDM2 and/or MDMX in a subject comprising administering to the subject an aqueous pharmaceutical formulation comprising a peptidomimetic macrocycle capable of binding to the MDM2 and/or MDMX proteins, wherein the amount of the peptidomimetic macrocycle in the aqueous pharmaceutical formulation is greater than 15 mg/mL and wherein the aqueous pharmaceutical formulation contains less than 2% w/v of any micelle forming agent. The aqueous pharmaceutical formulation can further comprise a buffering agent, a tonicity agent, and/or a stabilizing agent.

In another aspect, the disclosure provides a method of antagonizing the interaction between p53 and MDM2 and/or between p53 and MDMX proteins in a subject, the method comprising administering to the subject a aqueous pharmaceutical formulation comprising a peptidomimetic macrocycle capable of binding to the MDM2 and/or MDMX proteins, wherein the amount of the peptidomimetic macrocycle in the aqueous pharmaceutical formulation is greater than 15 mg/mL and wherein the aqueous pharmaceutical formulation contains less than 2% w/v of any micelle forming agent. The aqueous pharmaceutical formulation can further comprise a buffering agent, a stabilizing agent and/or a tonicity agent.

In another aspect, the disclosure provides a method of making an aqueous pharmaceutical formulation comprising adding greater than 15 mg/mL of a peptidomimetic macrocycle or a pharmaceutically acceptable salt thereof to water or an aqueous solution, wherein the peptidomimetic macrocycle is capable of binding to the MDM2 and/or MDMX proteins and wherein the aqueous pharmaceutical formulation comprises less than 2% w/v of any micelle forming agent. In some examples, the method comprises adding a sodium salt of the peptidomimetic macrocycle to water or an aqueous solution. The aqueous solution can comprise a buffering agent. The aqueous solution can also comprise a tonicity agent. The aqueous solution can further comprise a stabilizing agent.

The method can further comprise adjusting the pH of the solution comprising the buffering agent and the stabilizing agent during the addition of the peptidomimetic macrocycle. The pH can be adjusted by addition of a pH adjusting agent. In some examples, the pH is adjusted to be in the range of from about 6.0-8.0.

The amount of the pH adjusting agent added can be from about 0.01-10% w/v, for example about 0.09% w/v. The pH adjusting agent can comprise an acid or a base. In some examples, the pH adjusting agent comprises phosphoric acid. In some examples, the pH adjusting agent comprises sodium hydroxide, for example 0.1 N NaOH.

The method can further comprise filtration of the aqueous pharmaceutical formulation obtained after the addition of the peptidomimetic macrocycle to the aqueous solution. The filtration is performed under vacuum or under pressure. The filtration can comprise sterilizing filtration. In some examples, the filtration comprises use of membrane filter. In some examples, the membrane filter comprises cellulose or cellulose derivative, cellulosic ester (MCE), comprise polytetrafluoroethylene (PTFE), polyvinylidene, polyvinylidene chloride, or polyvinylidene fluoride. The membrane filter can have a pore size in the range from about 10 nm-10 µm, for example 0.2 The filtration can result in clarification of the aqueous formulation. The filtering can involve passing the aqueous pharmaceutical formulation through one or more membrane filters.

In another aspect, the disclosure provides a kit comprising, in suitable container means, an aqueous pharmaceutical formulation comprising a peptidomimetic macrocycle and instructions for administration of the aqueous pharmaceutical formulation to a human subject, wherein the peptidomimetic macrocycle is capable of binding to MDM2 and/or MDMX proteins and wherein the amount of the peptidomimetic macrocycle in the aqueous pharmaceutical formulation is greater than 15 mg/mL and the aqueous pharmaceutical formulation comprises less than 2% w/v of any micelle forming agent. The instructions can be for intravenous administration of the aqueous formulation.

In some embodiments, the amount of aqueous pharmaceutical formulation made is about 1 liter to about 100 liters. In some embodiments, the amount of aqueous pharmaceutical formulation made is about 10 litres to about 100 litres. In some embodiments the amount of aqueous pharmaceutical formulation made is about 10 liters to about 50 liters.

A kit for formulating an aqueous pharmaceutical formulation comprising, in suitable container means, a peptidomimetic macrocycle capable of binding to the MDM2 and/or MDMX proteins or a pharmaceutically acceptable salt thereof, wherein the amount of the peptidomimetic macrocycle in the aqueous pharmaceutical formulation is greater than 15 mg/mL and the aqueous pharmaceutical formulation comprises less than 2% w/v of any micelle forming agent.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the disclosure are set forth with particularity in the appended claims. A better understanding of the features and advantages of the present disclosure will be obtained by reference to the following detailed description that sets forth illustrative embodiments, in which the principles of the disclosure are utilized, and the accompanying drawings of which:

DETAILED DESCRIPTION OF THE DISCLOSURE

Figure 1:
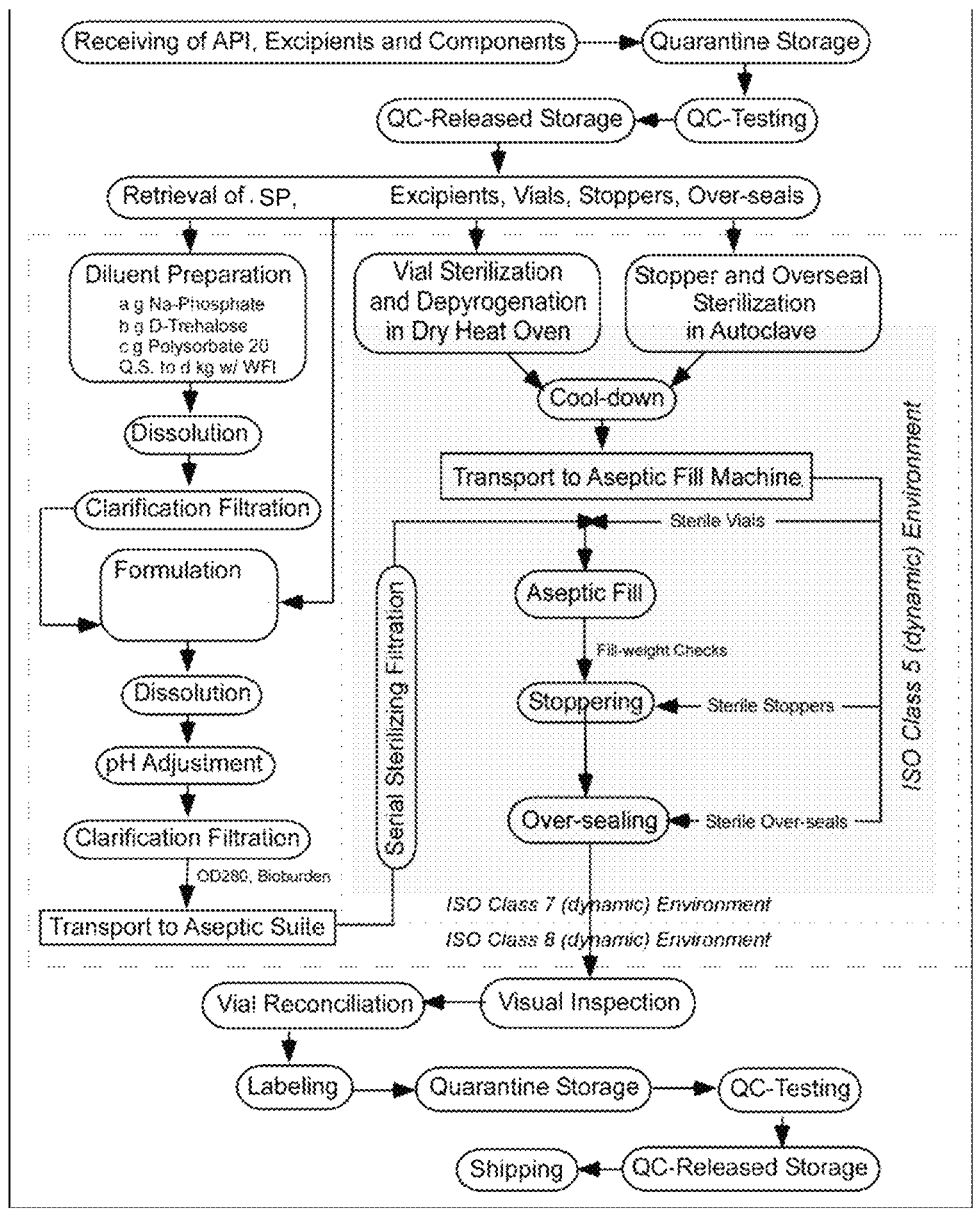
FIG. 1. Shows a flow diagram of the manufacturing process of an exemplary aqueous pharmaceutical formulation of the disclosure.

While preferred embodiments of the present disclosure have been shown and described herein, it will be obvious to those skilled in the art that such embodiments are provided by way of example only. Numerous variations, changes, and substitutions will now occur to those skilled in the art without departing from the disclosure. It should be understood that various alternatives to the embodiments of the disclosure described herein can be employed in practicing the disclosure. It is intended that the following claims define the scope of the disclosure and that methods and structures within the scope of these claims and their equivalents be covered thereby.

Definitions

As used herein, the term "macrocycle" refers to a molecule having a chemical structure including a ring or cycle formed by at least 9 covalently bonded atoms.

As used herein, the term "peptidomimetic macrocycle" or "crosslinked polypeptide" refers to a compound comprising a plurality of amino acid residues joined by a plurality of peptide bonds and at least one macrocycle-forming linker which forms a macrocycle between a first naturally-occurring or non-naturally-occurring amino acid residue (or analog) and a second naturally-occurring or non-naturally-occurring amino acid residue (or analog) within the same molecule. Peptidomimetic macrocycle include embodiments where the macrocycle-forming linker connects the α carbon of the first amino acid residue (or analog) to the α carbon of the second amino acid residue (or analog). The peptidomimetic macrocycles optionally include one or more non-peptide bonds between one or more amino acid residues and/or amino acid analog residues, and optionally include one or more non-naturally-occurring amino acid residues or amino acid analog residues in addition to any which form the macrocycle. A "corresponding uncrosslinked polypeptide" when referred to in the context of a peptidomimetic macrocycle is understood to relate to a polypeptide of the same length as the macrocycle and comprising the equivalent natural amino acids of the wild-type sequence corresponding to the macrocycle.

As used herein, the term "pharmaceutically acceptable salt" refers to those salts which are suitable for pharmaceutical use, preferably for use in humans and lower animals without undue irritation, allergic response and the like. Pharmaceutically acceptable salts of amines, carboxylic acids, and other types of compounds, are well known in the art. For example, S. M. Berge, et al., describe pharmaceutically acceptable salts in detail in J Pharmaceutical Sciences, 66: 1-19 (1977), incorporated herein by reference. The salts can be prepared in situ during the final isolation and purification of the peptidomimetic macrocycles of the invention, or separately by reacting a free base or free acid function with a suitable reagent, as described generally below. For example, a free base function can be reacted with a suitable acid. Suitable pharmaceutically acceptable salts can, include metal salts such as alkali metal salts, e. g. sodium, potassium, and lithium salts; and alkaline earth metal salts, e. g. calcium or magnesium salts. Examples of pharmaceutically acceptable, nontoxic acid addition salts are salts of an amino group formed with inorganic acids such as hydrochloric acid, hydrobromic acid, hydroiodic acid, phosphoric acid, sulfuric acid and perchloric acid or with organic acids such as acetic acid, oxalic acid, maleic acid, tartaric acid, citric acid, succinic acid or malonic acid or by using other methods used in the art such as ion exchange. Other pharmaceutically acceptable salts include adipate, alginate, ascorbate, aspartate, benzoate, bisulfate, borate, butyrate, camphorate, camphorsulfonate, citrate, cyclopentanepropionate, digluconate, dodecylsulfate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, nicotinate, nitrate, oleate, oxalate, palmitate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like.

As used herein, the term "stability" can refer to chemical stability and/or physical stability. As used herein, the phrase chemical stability means the ability of a compound to maintain its chemical identity over time. Accordingly, stability implies the ability of a chemical species to resist oxidation or other degradation, for example. As used herein, the phrase physical stability means the ability of a composition to maintain consistent physical properties over time. The ability of a composition to maintain a consistent disintegration time over time is exemplary of physical stability. In some embodiments, stability can also refer to the maintenance of a defined secondary structure in solution by a peptidomimetic macrocycle as measured by circular dichroism, NMR or another biophysical measure, or resistance to proteolytic degradation in vitro or in vivo. Non-limiting examples of secondary structures contemplated herein are α-helices, $3_{10}$ helices, β-turns, and β-pleated sheets.

The term "amino acid" refers to a molecule containing both an amino group and a carboxyl group. Suitable amino acids include, without limitation, both the D- and L-isomers of the naturally-occurring amino acids, as well as non-naturally occurring amino acids prepared by organic synthesis or other metabolic routes. The term amino acid, as used herein, includes, without limitation, α-amino acids, natural amino acids, non-natural amino acids, and amino acid analogs.

The term "α-amino acid" refers to a molecule containing both an amino group and a carboxyl group bound to a carbon which is designated the α-carbon.

The term "β-amino acid" refers to a molecule containing both an amino group and a carboxyl group in a β configuration.

The term "naturally occurring amino acid" refers to any one of the twenty amino acids commonly found in peptides synthesized in nature, and known by the one letter abbreviations A, R, N, C, D, Q, E, G, H, I, L, K, M, F, P, S, T, W, Y and V.

The following table shows a summary of the properties of natural amino acids:

| Amino Acid | 3-Letter Code | 1-Letter Code | Side-chain Polarity | Side-chain charge (pH 7.4) | Hydropathy Index |
|---|---|---|---|---|---|
| Alanine | Ala | A | nonpolar | neutral | 1.8 |
| Arginine | Arg | R | polar | positive | −4.5 |
| Asparagine | Asn | N | polar | neutral | −3.5 |
| Aspartic acid | Asp | D | polar | negative | −3.5 |
| Cysteine | Cys | C | polar | neutral | 2.5 |
| Glutamic acid | Glu | E | polar | negative | −3.5 |
| Glutamine | Gln | Q | polar | neutral | −3.5 |
| Glycine | Gly | G | nonpolar | neutral | −0.4 |
| Histidine | His | H | polar | positive (10%) neutral (90%) | −3.2 |
| Isoleucine | Ile | I | nonpolar | neutral | 4.5 |
| Leucine | Leu | L | nonpolar | neutral | 3.8 |
| Lysine | Lys | K | polar | positive | −3.9 |
| Methionine | Met | M | nonpolar | neutral | 1.9 |
| Phenylalanine | Phe | F | nonpolar | neutral | 2.8 |
| Proline | Pro | P | nonpolar | neutral | −1.6 |
| Serine | Ser | S | polar | neutral | −0.8 |
| Threonine | Thr | T | polar | neutral | −0.7 |
| Tryptophan | Trp | W | nonpolar | neutral | −0.9 |
| Tyrosine | Tyr | Y | polar | neutral | −1.3 |
| Valine | Val | V | nonpolar | neutral | 4.2 |

"Hydrophobic amino acids" include small hydrophobic amino acids and large hydrophobic amino acids. "Small hydrophobic amino acid" are glycine, alanine, proline, and analogs thereof. "Large hydrophobic amino acids" are valine, leucine, isoleucine, phenylalanine, methionine, tryptophan, and analogs thereof. "Polar amino acids" are serine, threonine, asparagine, glutamine, cysteine, tyrosine, and analogs thereof. "Charged amino acids" are lysine, arginine, histidine, aspartate, glutamate, and analogs thereof.

The term "amino acid analog" refers to a molecule which is structurally similar to an amino acid and which can be substituted for an amino acid in the formation of a peptidomimetic macrocycle. Amino acid analogs include, without limitation, β-amino acids and amino acids where the amino or carboxy group is substituted by a similarly reactive group (e.g., substitution of the primary amine with a secondary or tertiary amine, or substitution of the carboxy group with an ester).

The term "non-natural amino acid" refers to an amino acid which is not one of the twenty amino acids commonly found in peptides synthesized in nature, and known by the one letter abbreviations A, R, N, C, D, Q, E, G, H, I, L, K, M, F, P, S, T, W, Y and V. Non-natural amino acids or amino acid analogs include, without limitation, structures according to the following:

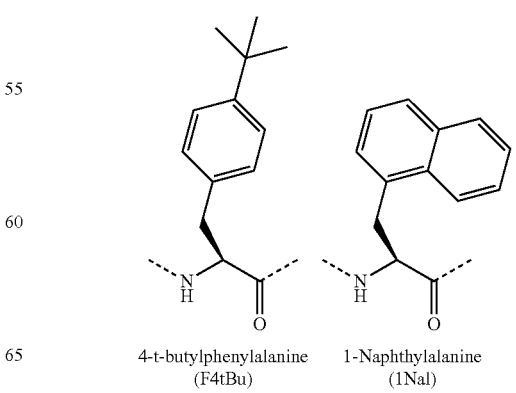

4-t-butylphenylalanine (F4tBu)  1-Naphthylalanine (1Nal)

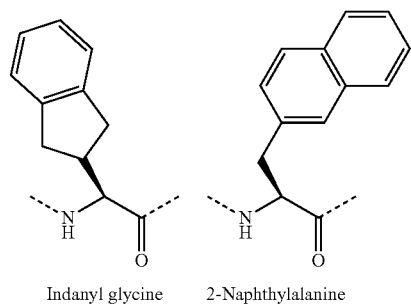

Indanyl glycine (Igl)    2-Naphthylalanine (2Nal)

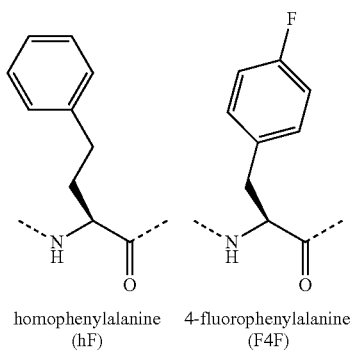

homophenylalanine (hF)    4-fluorophenylalanine (F4F)

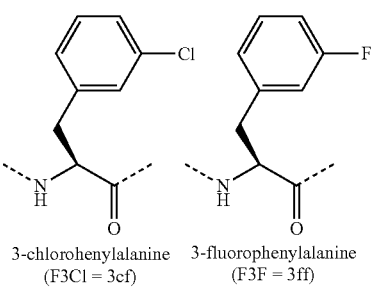

3-chlorohenylalanine (F3Cl = 3cf)    3-fluorophenylalanine (F3F = 3ff)

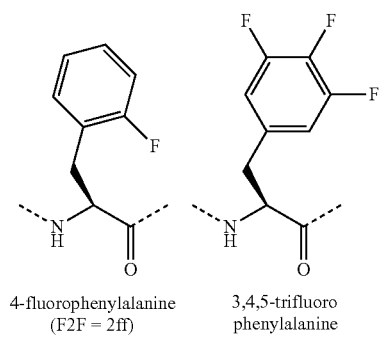

4-fluorophenylalanine (F2F = 2ff)    3,4,5-trifluoro phenylalanine (F345F3)

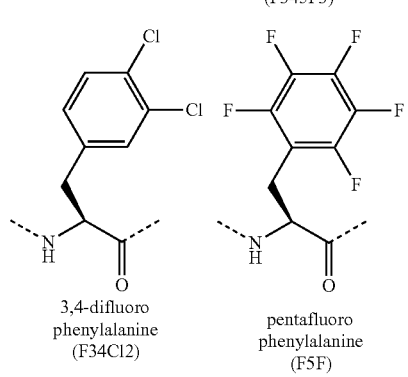

3,4-difluoro phenylalanine (F34Cl2)    pentafluoro phenylalanine (F5F)

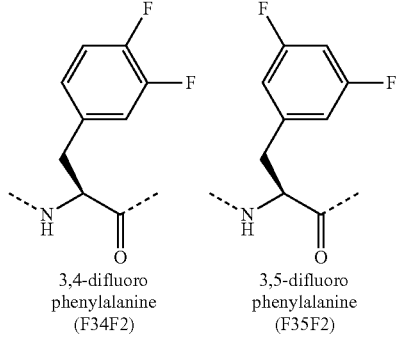

3,4-difluoro phenylalanine (F34F2)    3,5-difluoro phenylalanine (F35F2)

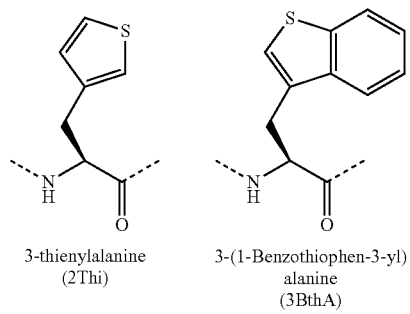

3-thienylalanine (2Thi)    3-(1-Benzothiophen-3-yl) alanine (3BthA)

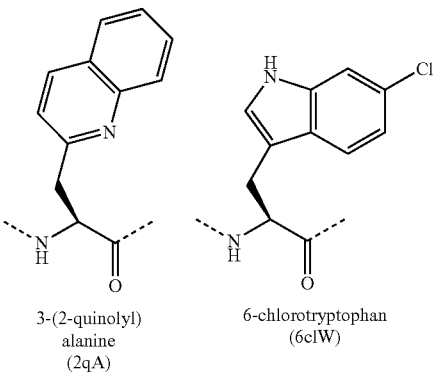

3-(2-quinolyl) alanine (2qA)    6-chlorotryptophan (6clW)

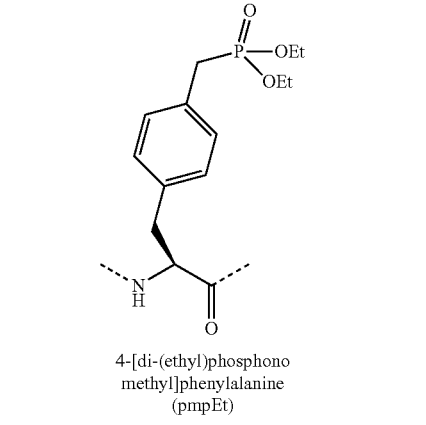

4-[di-(ethyl)phosphono methyl]phenylalanine (pmpEt)

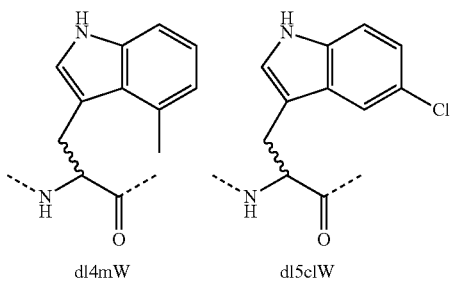

dl4mW    dl5clW

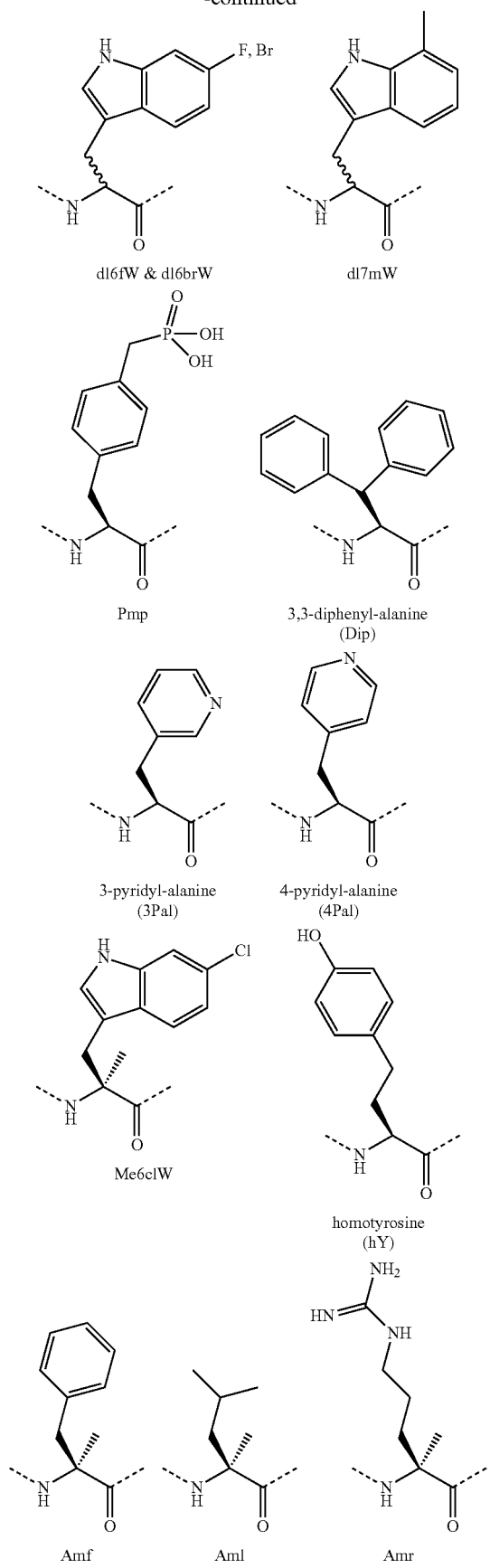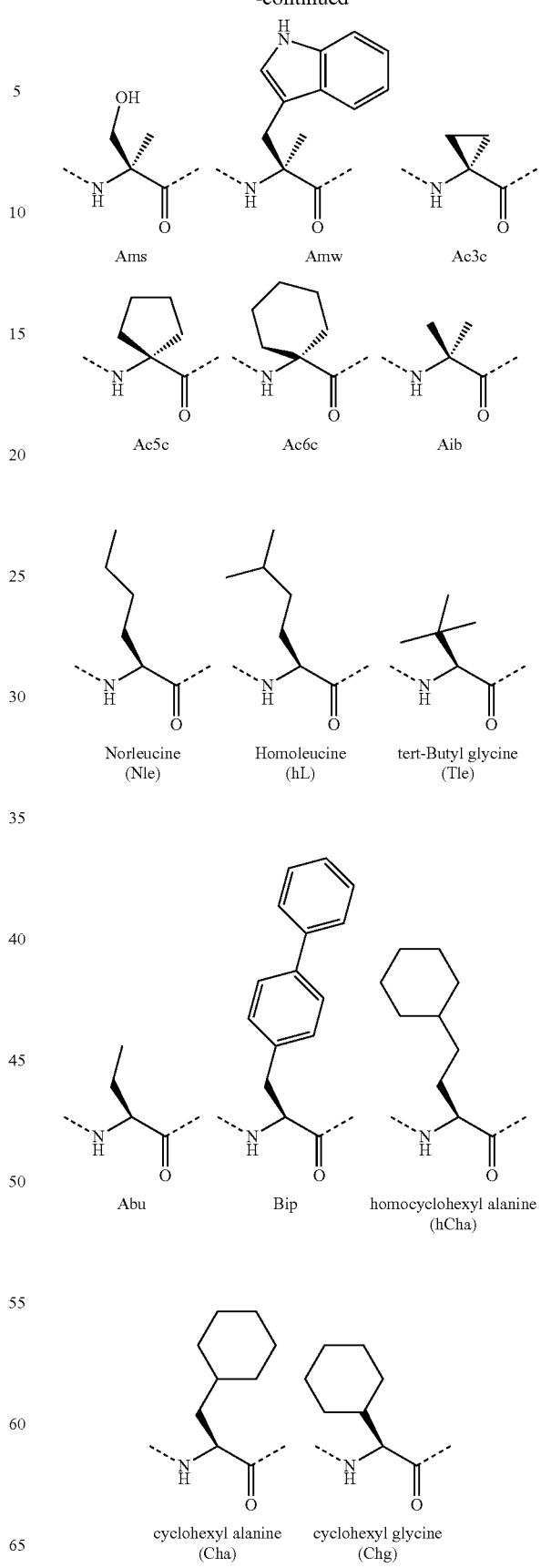

-continued
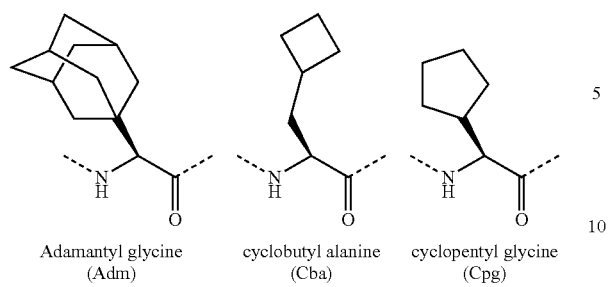
Adamantyl glycine (Adm)  cyclobutyl alanine (Cba)  cyclopentyl glycine (Cpg)
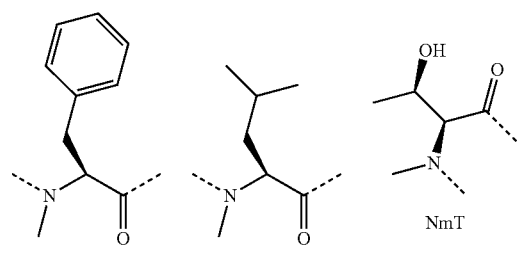
NmF  NmL  NmT
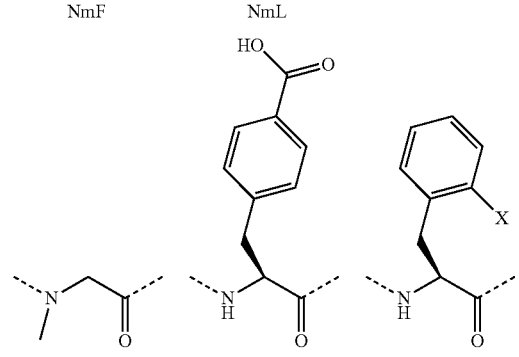
Sar  F4cooh  F2X
X = Cl, Br, CF3, CN, Me, NO2
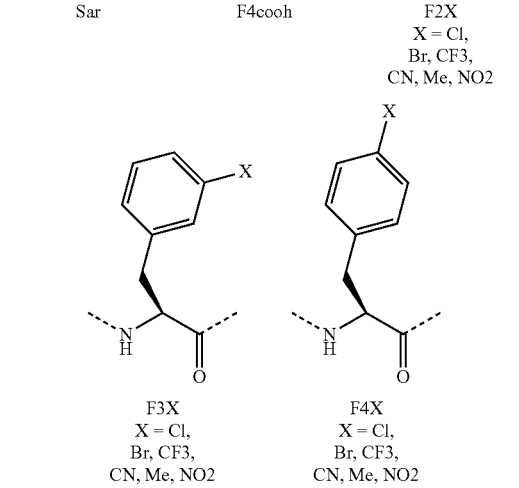
F3X
X = Cl, Br, CF3, CN, Me, NO2
F4X
X = Cl, Br, CF3, CN, Me, NO2
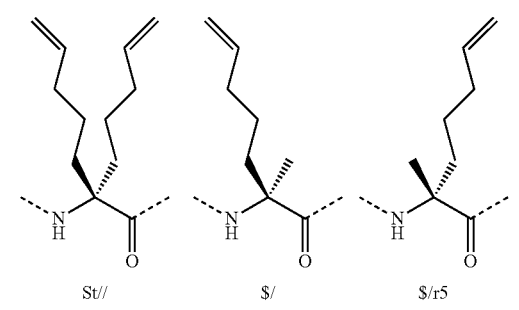
St//  $/  $/r5
-continued
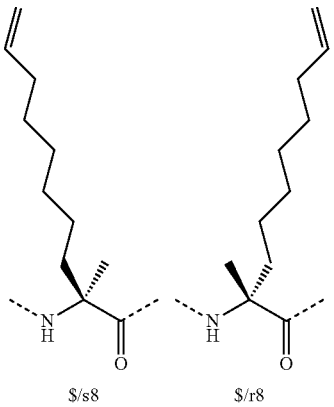
$/s8  $/r8
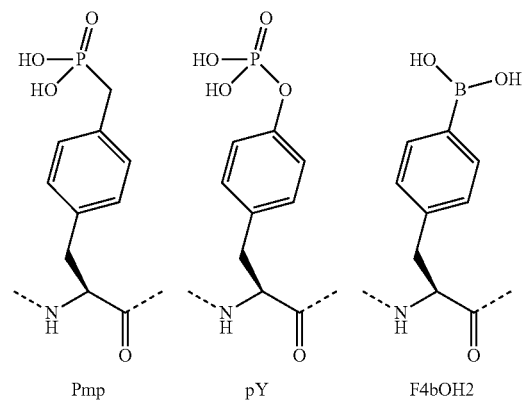
Pmp  pY  F4bOH2
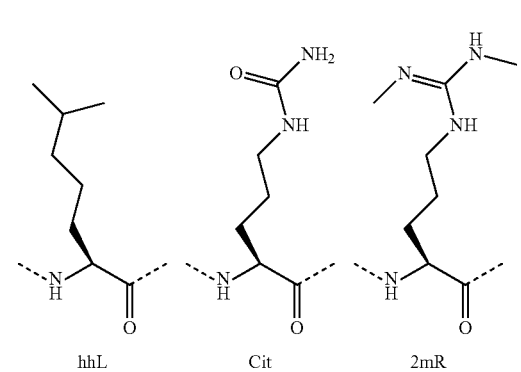
hhL  Cit  2mR
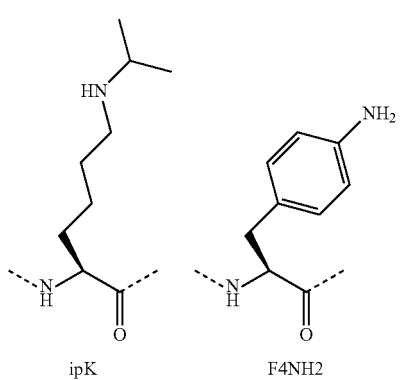
ipK  F4NH2

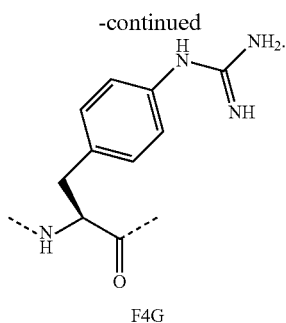

F4G

Amino acid analogs include β-amino acid analogs. Examples of β-amino acid analogs include, but are not limited to, the following: cyclic β-amino acid analogs; β-alanine; (R)-β-phenylalanine; (R)-1,2,3,4-tetrahydro-isoquinoline-3-acetic acid; (R)-3-amino-4-(1-naphthyl)-butyric acid; (R)-3-amino-4-(2,4-dichlorophenyl)butyric acid; (R)-3-amino-4-(2-chlorophenyl)-butyric acid; (R)-3-amino-4-(2-cyanophenyl)-butyric acid; (R)-3-amino-4-(2-fluorophenyl)-butyric acid; (R)-3-amino-4-(2-furyl)-butyric acid; (R)-3-amino-4-(2-methylphenyl)-butyric acid; (R)-3-amino-4-(2-naphthyl)-butyric acid; (R)-3-amino-4-(2-thienyl)-butyric acid; (R)-3-amino-4-(2-trifluoromethylphenyl)-butyric acid; (R)-3-amino-4-(3,4-dichlorophenyl)butyric acid; (R)-3-amino-4-(3,4-difluorophenyl)butyric acid; (R)-3-amino-4-(3-benzothienyl)-butyric acid; (R)-3-amino-4-(3-chlorophenyl)-butyric acid; (R)-3-amino-4-(3-cyanophenyl)-butyric acid; (R)-3-amino-4-(3-fluorophenyl)-butyric acid; (R)-3-amino-4-(3-methylphenyl)-butyric acid; (R)-3-amino-4-(3-pyridyl)-butyric acid; (R)-3-amino-4-(3-thienyl)-butyric acid; (R)-3-amino-4-(3-trifluoromethylphenyl)-butyric acid; (R)-3-amino-4-(4-bromophenyl)-butyric acid; (R)-3-amino-4-(4-chlorophenyl)-butyric acid; (R)-3-amino-4-(4-cyanophenyl)-butyric acid; (R)-3-amino-4-(4-fluorophenyl)-butyric acid; (R)-3-amino-4-(4-iodophenyl)-butyric acid; (R)-3-amino-4-(4-methylphenyl)-butyric acid; (R)-3-amino-4-(4-nitrophenyl)-butyric acid; (R)-3-amino-4-(4-pyridyl)-butyric acid; (R)-3-amino-4-(4-trifluoromethylphenyl)-butyric acid; (R)-3-amino-4-pentafluoro-phenylbutyric acid; (R)-3-amino-5-hexenoic acid; (R)-3-amino-5-hexynoic acid; (R)-3-amino-5-phenylpentanoic acid; (R)-3-amino-6-phenyl-5-hexenoic acid; (S)-1,2,3,4-tetrahydro-isoquinoline-3-acetic acid; (S)-3-amino-4-(1-naphthyl)-butyric acid; (S)-3-amino-4-(2,4-dichlorophenyl)butyric acid; (S)-3-amino-4-(2-chlorophenyl)-butyric acid; (S)-3-amino-4-(2-cyanophenyl)-butyric acid; (S)-3-amino-4-(2-fluorophenyl)-butyric acid; (S)-3-amino-4-(2-furyl)-butyric acid; (S)-3-amino-4-(2-methylphenyl)-butyric acid; (S)-3-amino-4-(2-naphthyl)-butyric acid; (S)-3-amino-4-(2-thienyl)-butyric acid; (S)-3-amino-4-(2-trifluoromethylphenyl)-butyric acid;
(S)-3-amino-4-(3,4-dichlorophenyl)butyric acid; (S)-3-amino-4-(3,4-difluorophenyl)butyric acid; (S)-3-amino-4-(3-benzothienyl)-butyric acid; (S)-3-amino-4-(3-chlorophenyl)-butyric acid; (S)-3-amino-4-(3-cyanophenyl)-butyric acid; (S)-3-amino-4-(3-fluorophenyl)-butyric acid; (S)-3-amino-4-(3-methylphenyl)-butyric acid; (S)-3-amino-4-(3-pyridyl)-butyric acid; (S)-3-amino-4-(3-thienyl)-butyric acid; (S)-3-amino-4-(3-trifluoromethylphenyl)-butyric acid; (S)-3-amino-4-(4-bromophenyl)-butyric acid; (S)-3-amino-4-(4-chlorophenyl)-butyric acid; (S)-3-amino-4-(4-cyanophenyl)-butyric acid; (S)-3-amino-4-(4-fluorophenyl)-butyric acid; (S)-3-amino-4-(4-iodophenyl)-butyric acid; (S)-3-amino-4-(4-methylphenyl)-butyric acid; (S)-3-amino-4-(4-nitrophenyl)-butyric acid; (S)-3-amino-4-(4-pyridyl)-butyric acid; (S)-3-amino-4-(4-trifluoromethylphenyl)-butyric acid; (S)-3-amino-4-pentafluoro-phenylbutyric acid; (S)-3-amino-5-hexenoic acid; (S)-3-amino-5-hexynoic acid; (S)-3-amino-5-phenylpentanoic acid; (S)-3-amino-6-phenyl-5-hexenoic acid; 1,2,5,6-tetrahydropyridine-3-carboxylic acid; 1,2,5,6-tetrahydropyridine-4-carboxylic acid; 3-amino-3-(2-chlorophenyl)-propionic acid; 3-amino-3-(2-thienyl)-propionic acid; 3-amino-3-(3-bromophenyl)-propionic acid; 3-amino-3-(4-chlorophenyl)-propionic acid; 3-amino-3-(4-methoxyphenyl)-propionic acid; 3-amino-4,4,4-trifluoro-butyric acid; 3-aminoadipic acid; D-β-phenylalanine; β-leucine; L-β-homoalanine; L-β-homoaspartic acid γ-benzyl ester; L-β-homoglutamic acid δ-benzyl ester; L-β-homoisoleucine; L-β-homoleucine; L-β-homomethionine; L-β-homophenylalanine; L-β-homoproline; L-β-homotryptophan; L-β-homovaline; L-Nω-benzyloxycarbonyl-β-homolysine; Nω-L-β-homoarginine; O-benzyl-L-β-homohydroxyproline; O-benzyl-L-β-homoserine; O-benzyl-L-β-homothreonine; O-benzyl-L-β-homotyrosine; γ-trityl-L-β-homoasparagine; (R)-β-phenylalanine; L-β-homoaspartic acid γ-t-butyl ester; L-β-homoglutamic acid δ-t-butyl ester; L-Nω-β-homolysine; Nδ-trityl-L-β-homoglutamine; Nω-2,2,4,6,7-pentamethyl-dihydrobenzofuran-5-sulfonyl-L-β-homoarginine; O-t-butyl-L-β-homohydroxy-proline; O-t-butyl-L-β-homoserine; O-t-butyl-L-β-homothreonine; O-t-butyl-L-β-homotyrosine; 2-aminocyclopentane carboxylic acid; and 2-aminocyclohexane carboxylic acid.

Amino acid analogs include analogs of alanine, valine, glycine or leucine. Examples of amino acid analogs of alanine, valine, glycine, and leucine include, but are not limited to, the following: α-methoxyglycine; α-allyl-L-alanine; α-aminoisobutyric acid; α-methyl-leucine; β-(1-naphthyl)-D-alanine; β-(1-naphthyl)-L-alanine; β-(2-naphthyl)-D-alanine; β-(2-naphthyl)-L-alanine; β-(2-pyridyl)-D-alanine; β-(2-pyridyl)-L-alanine; β-(2-thienyl)-D-alanine; β-(2-thienyl)-L-alanine; β-(3-benzothienyl)-D-alanine; β-(3-benzothienyl)-L-alanine; β-(3-pyridyl)-D-alanine; β-(3-pyridyl)-L alanine; -(4-pyridyl)-D-alanine; β-(4-pyridyl)-L-alanine; -chloro-L-alanine; -cyano-L -alanin; β-cyclohexyl-D-alanine; β-cyclohexyl-L-alanine; β-cyclopenten-1-yl-alanine; β-cyclopentyl alanine; β-cyclopropyl-L-Ala-OH.dicyclohexylammonium salt; β-t-butyl-D-alanine; β-t-butyl-L alanine; γ-aminobutyric acid; L-α,β-diaminopropionic acid; 2,4-dinitro-phenylglycine; 2,5-dihydro-D-phenylglycine; 2-amino-4,4,4-trifluorobutyric acid; 2-fluoro-phenylglycine; 3-amino-4,4,4-trifluoro-butyric acid; 3-fluoro-valine; 4,4,4-trifluoro-valine; 4,5-dehydro-L-leu-OH.dicyclohexylammonium salt; 4-fluoro-D-phenylglycine; 4-fluoro-L-phenylglycine; 4-hydroxy-D-phenylglycine; 5,5,5-trifluoro-leucine; 6-aminohexanoic acid; cyclopentyl-D-Gly-OH.dicyclohexylammonium salt; cyclopentyl-Gly-OH.dicyclohexylammonium salt; D-α,β-diaminopropionic acid; D-α-aminobutyric acid; D-α-t-butylglycine; D-(2-thienyl)glycine; D-(3-thienyl)glycine; D-2-aminocaproic acid; D-2-indanylglycine; D-allylglycine.dicyclohexylammonium salt; D-cyclohexylglycine; D-norvaline; D-phenylglycine; β-aminobutyric acid; β-aminoisobutyric acid; (2-bromophenyl)glycine; (2-methoxyphenyl)glycine; (2-methylphenyl)glycine; (2-thiazoyl)glycine; (2-thienyl)glycine; 2-amino-3-(dimethylamino)-propionic acid; L-α,β-diaminopropionic acid; L-α-aminobutyric acid; L-α-t-butylglycine; L-(3-thienyl) glycine; L-2-amino-3-(dimethylamino)-propionic acid; L-2-aminocaproic acid dicyclohexyl-ammonium salt; L-2-indanylglycine; L-allylglycine-dicyclohexyl ammonium salt; L-cyclohexylglycine; L-phenylglycine; L-propargylglycine; L-norvaline; N-α-aminomethyl-L-alanine; D-α,γ-diaminobutyric acid; L-α,γ-diaminobutyric acid; β-cyclopropyl-L-alanine; (N-β-(2,4-dinitrophenyl))-L-α,β-diaminopropionic acid; (N-β-1-(4,4-dimethyl-2,6-dioxocyclohex-1-ylidene)ethyl)-D-α,β-diaminopropionic acid; (N-β-1-(4,4-dimethyl-2,6-dioxocyclohex-1-ylidene)ethyl)-L-α,β-diaminopropionic acid; (N-β-4-methyltrityl)-L-α,β-diaminopropionic acid; (N-β-allyloxycarbonyl)-L-α,β-diaminopropionic acid; (N-γ-1-(4,4-dimethyl-2,6-dioxocyclohex-1-ylidene)ethyl)-D-α,γ-diaminobutyric acid; (N-γ-1-(4,4-dimethyl-2,6-dioxocyclohex-1-ylidene)ethyl)-L-α,γ-diaminobutyric acid; (N-γ-4-methyltrityl)-D-α,γ-diaminobutyric acid; (N-γ-4-methyltrityl)-L-α,γ-diaminobutyric acid; (N-γ-allyloxycarbonyl)-L-α,γ-diaminobutyric acid; D-α,γ-diaminobutyric acid; 4,5-dehydro-L-leucine; cyclopentyl-D-Gly-OH; cyclopentyl-Gly-OH; D-allylglycine; D-homocyclohexylalanine; L-1-pyrenylalanine; L-2-aminocaproic acid; L-allylglycine; L-homocyclohexylalanine; and N-(2-hydroxy-4-methoxy-Bzl)-Gly-OH.

Amino acid analogs include analogs of arginine or lysine. Examples of amino acid analogs of arginine and lysine include, but are not limited to, the following: citrulline; L-2-amino-3-guanidinopropionic acid; L-2-amino-3-ureidopropionic acid; L-citrulline; Lys(Me)$_2$-OH; Lys(N$_3$)—OH; Nδ-benzyloxycarbonyl-L-ornithine; Nω-nitro-D-arginine; Nω-nitro-L-arginine; α-methyl-ornithine; 2,6-diaminoheptanedioic acid; L-ornithine; (Nδ-1-(4,4-dimethyl-2,6-dioxocyclohex-1-ylidene)ethyl)-D-ornithine; (Nδ-1-(4,4-dimethyl-2,6-dioxo-cyclohex-1-ylidene)ethyl)-L-ornithine; (Nδ-4-methyltrityl)-D-ornithine; (Nδ-4-methyltrityl)-L-ornithine; D-ornithine; L-ornithine; Arg(Me)(Pbf)-OH; Arg(Me)$_2$-OH (asymmetrical); Arg(Me)2-OH (symmetrical); Lys(ivDde)-OH; Lys(Me)2-OH.HCl; Lys(Me3)-OH chloride; Nω-nitro-D-arginine; and Nω-nitro-L-arginine.

Amino acid analogs include analogs of aspartic or glutamic acids. Examples of amino acid analogs of aspartic and glutamic acids include, but are not limited to, the following: α-methyl-D-aspartic acid; α-methyl-glutamic acid; α-methyl-L-aspartic acid; γ-methylene-glutamic acid; (N-γ-ethyl)-L-glutamine; [N-α-(4-aminobenzoyl)]-L-glutamic acid; 2,6-diaminopimelic acid; L-α-aminosuberic acid; D-2-aminoadipic acid; D-α-aminosuberic acid; α-aminopimelic acid; iminodiacetic acid; L-2-aminoadipic acid; threo-β-methyl-aspartic acid; γ-carboxy-D-glutamic acid γ,γ-di-t-butyl ester; γ-carboxy-L-glutamic acid γ,γ-di-t-butyl ester; Glu(OAll)-OH; L-Asu(OtBu)-OH; and pyroglutamic acid.

Amino acid analogs include analogs of cysteine and methionine. Examples of amino acid analogs of cysteine and methionine include, but are not limited to, Cys(farnesyl)-OH, Cys(farnesyl)-OMe, α-methyl-methionine, Cys(2-hydroxyethyl)-OH, Cys(3-aminopropyl)-OH, 2-amino-4-(ethylthio)butyric acid, buthionine, buthioninesulfoximine, ethionine, methionine methylsulfonium chloride, selenomethionine, cysteic acid, [2-(4-pyridyl)ethyl]-DL-penicillamine, [2-(4-pyridyl)ethyl]-L-cysteine, 4-methoxybenzyl-D-penicillamine, 4-methoxybenzyl-L-penicillamine, 4-methylbenzyl-D-penicillamine, 4-methylbenzyl-L penicillamine, benzyl-D-cysteine, benzyl-L-cysteine, benzyl-DL-homocysteine, carbamoyl-L-cysteine, carboxyethyl-L-cysteine, carboxymethyl-L-cysteine, diphenylmethyl-L-cysteine, ethyl-L-cysteine, methyl-L-cysteine, t-butyl-D-cysteine, trityl-L-homocysteine, trityl-D-penicillamine, cystathionine, homocystine, L-homocystine, (2-aminoethyl)-L-cysteine, seleno-L-cysteine, cystathionine, Cys(StBu)-OH, and acetamidomethyl-D-penicillamine.

Amino acid analogs include analogs of phenylalanine and tyrosine. Examples of amino acid analogs of phenylalanine and tyrosine include β-methyl-phenylalanine, β-hydroxyphenylalanine, α-methyl-3-methoxy-DL-phenylalanine, α-methyl-D-phenylalanine, α-methyl-L-phenylalanine, 1,2,3,4-tetrahydroisoquinoline-3-carboxylic acid, 2,4-dichlorophenylalanine, 2-(trifluoromethyl)-D-phenylalanine, 2-(trifluoromethyl)-L-phenylalanine, 2-bromo-D-phenylalanine, 2-bromo-L-phenylalanine, 2-chloro-D-phenylalanine, 2-chloro-L-phenylalanine, 2-cyano-D-phenylalanine, 2-cyano-L-phenylalanine, 2-fluoro-D-phenylalanine, 2-fluoro-L-phenylalanine, 2-methyl-D-phenylalanine, 2-methyl-L-phenylalanine, 2-nitro-D-phenylalanine, 2-nitro-L-phenylalanine, 2; 4; 5-trihydroxy-phenylalanine, 3,4,5-trifluoro-D-phenylalanine, 3,4,5-trifluoro-L-phenylalanine, 3,4-dichloro-D-phenylalanine, 3,4-dichloro-L-phenylalanine, 3,4-difluoro-D-phenylalanine, 3,4-difluoro-L-phenylalanine, 3,4-dihydroxy-L-phenylalanine, 3,4-dimethoxy-L-phenylalanine, 3,5,3'-triiodo-L thyronine, 3,5-diiodo-D-tyrosine, 3,5-diiodo-L-tyrosine, 3,5-diiodo-L-thyronine, 3-(trifluoromethyl)-D-phenylalanine, 3-(trifluoromethyl)-L-phenylalanine, 3-amino-L-tyrosine, 3-bromo-D-phenylalanine, 3-bromo-L-phenylalanine, 3-chloro-D-phenylalanine, 3-chloro-L-phenylalanine, 3-chloro-L-tyrosine, 3-cyano-D-phenylalanine, 3-cyano-L-phenylalanine, 3-fluoro-D-phenylalanine, 3-fluoro-L-phenylalanine, 3-fluoro-tyrosine, 3-iodo-D-phenylalanine, 3-iodo-L-phenylalanine, 3-iodo-L-tyrosine, 3-methoxy-L-tyrosine, 3-methyl-D-phenylalanine, 3-methyl-L-phenylalanine, 3-nitro-D-phenylalanine, 3-nitro-L-phenylalanine, 3-nitro-L-tyrosine, 4-(trifluoromethyl)-D-phenylalanine, 4-(trifluoromethyl)-L-phenylalanine, 4-amino-D-phenylalanine, 4-amino-L-phenylalanine, 4-benzoyl-D-phenylalanine, 4-benzoyl-L-phenylalanine, 4-bis(2-chloroethyl)amino-L-phenylalanine, 4-bromo-D-phenylalanine, 4-bromo-L-phenylalanine, 4-chloro-D-phenylalanine, 4-chloro-L-phenylalanine, 4-cyano-D-phenylalanine, 4-cyano-L-phenylalanine, 4-fluoro-D-phenylalanine, 4-fluoro-L-phenylalanine, 4-iodo-D-phenylalanine, 4-iodo-L-phenylalanine, homophenylalanine, thyroxine, 3,3-diphenylalanine, thyronine, ethyl-tyrosine, and methyl-tyrosine.

Amino acid analogs include analogs of proline. Examples of amino acid analogs of proline include, but are not limited to, 3,4-dehydro-proline, 4-fluoro-proline, cis-4-hydroxyproline, thiazolidine-2-carboxylic acid, and trans-4-fluoroproline.

Amino acid analogs include analogs of serine and threonine. Examples of amino acid analogs of serine and threonine include, but are not limited to, 3-amino-2-hydroxy-5-methylhexanoic acid, 2-amino-3-hydroxy-4-methylpentanoic acid, 2-amino-3 ethoxybutanoic acid, 2-amino-3-methoxybutanoic acid, 4-amino-3-hydroxy-6-methylheptanoic acid, 2-amino-3-benzyloxypropionic acid, 2-amino-3-benzyloxypropionic acid, 2-amino-3-ethoxypropionic acid, 4-amino-3-hydroxybutanoic acid, and α-methylserine.

Amino acid analogs include analogs of tryptophan. Examples of amino acid analogs of tryptophan include, but are not limited to, the following: α-methyl-tryptophan; β-(3-benzothienyl)-D-alanine; β-(3-benzothienyl)-L-alanine; 1-methyl-tryptophan; 4-methyl-tryptophan; 5-benzyloxy-tryptophan; 5-bromo-tryptophan; 5-chloro-tryptophan; 5-fluoro-tryptophan; 5-hydroxy-tryptophan; 5-hydroxy-L-tryptophan; 5-methoxy-tryptophan; 5-methoxy-L-tryptophan; 5-methyl-tryptophan; 6-bromo-tryptophan; 6-chloro-D-tryptophan; 6-chloro-tryptophan; 6-fluoro-tryptophan; 6-methyl-tryptophan; 7-benzyloxy-tryptophan; 7-bromo-tryptophan; 7-methyl-tryptophan; D-1,2,3,4-tetrahydronorharman-3-carboxylic acid; 6-methoxy-1,2,3,4-tetrahydronorharman-1-carboxylic acid; 7-azatryptophan; L-1,2,3,4-tetrahydro-norharman-3-carboxylic acid; 5-methoxy-2-methyl-tryptophan; and 6-chloro-L-tryptophan.

In some embodiments, amino acid analogs are racemic. In some embodiments, the D isomer of the amino acid analog is used. In some embodiments, the L isomer of the amino acid analog is used. In other embodiments, the amino acid analog comprises chiral centers that are in the R or S configuration. In still other embodiments, the amino group(s) of a β-amino acid analog is substituted with a protecting group, e.g., tert-butyloxycarbonyl (BOC group), 9-fluorenylmethyloxycarbonyl (FMOC), tosyl, and the like. In yet other embodiments, the carboxylic acid functional group of a β-amino acid analog is protected, e.g., as its ester derivative. In some embodiments the salt of the amino acid analog is used.

A "non-essential" amino acid residue is a residue that can be altered from the wild-type sequence of a polypeptide without abolishing or substantially altering its essential biological or biochemical activity (e.g., receptor binding or activation). An "essential" amino acid residue is a residue that, when altered from the wild-type sequence of the polypeptide, results in abolishing or substantially abolishing the polypeptide's essential biological or biochemical activity.

A "conservative amino acid substitution" is one in which the amino acid residue is replaced with an amino acid residue having a similar side chain. Families of amino acid residues having similar side chains have been defined in the art. These families include amino acids with basic side chains (e.g., K, R, H), acidic side chains (e.g., D, E), uncharged polar side chains (e.g., G, N, Q, S, T, Y, C), nonpolar side chains (e.g., A, V, L, I, P, F, M, W), beta-branched side chains (e.g., T, V, I) and aromatic side chains (e.g., Y, F, W, H). Thus, a predicted nonessential amino acid residue in a polypeptide, for example, is replaced with another amino acid residue from the same side chain family. Other examples of acceptable substitutions are substitutions based on isosteric considerations (e.g. norleucine for methionine) or other properties (e.g. 2-thienylalanine for phenylalanine, or 6-Cl-tryptophan for tryptophan).

The term "capping group" refers to the chemical moiety occurring at either the carboxy or amino terminus of the polypeptide chain of the subject peptidomimetic macrocycle. The capping group of a carboxy terminus includes an unmodified carboxylic acid (ie —COOH) or a carboxylic acid with a substituent. For example, the carboxy terminus can be substituted with an amino group to yield a carboxamide at the C-terminus. Various substituents include but are not limited to primary and secondary amines, including pegylated secondary amines. Representative secondary amine capping groups for the C-terminus include:

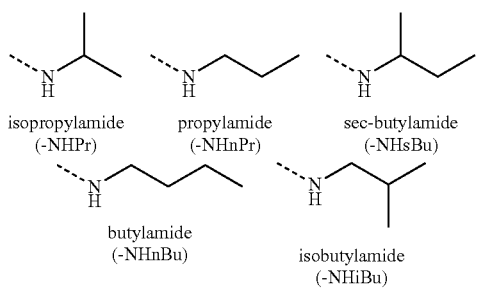

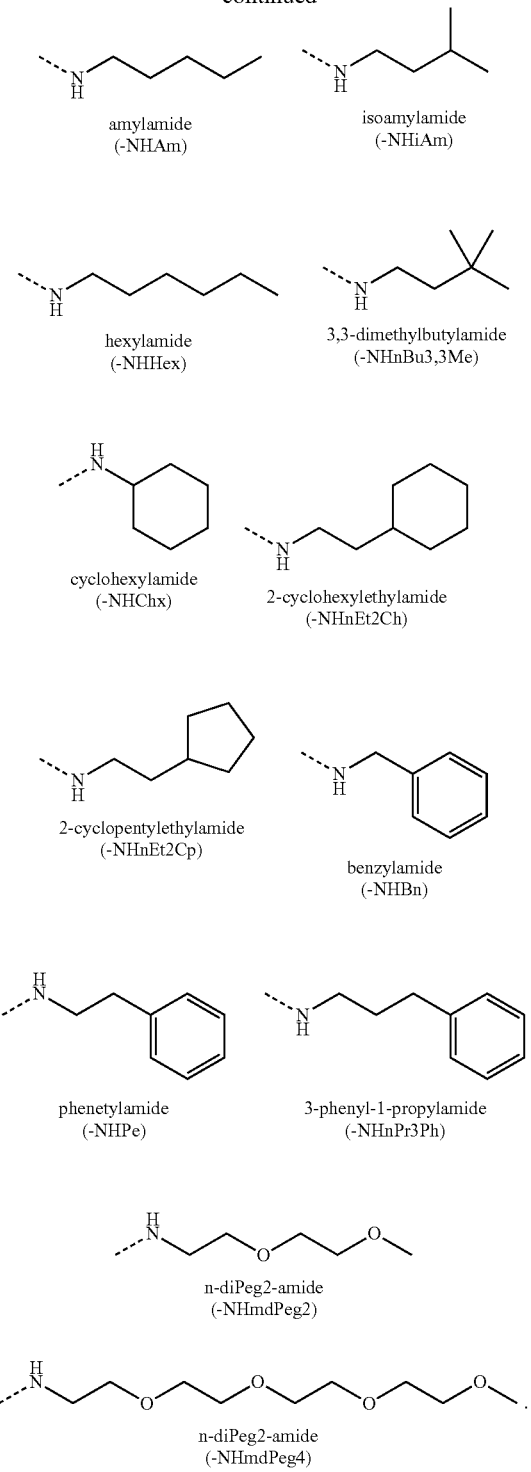

The capping group of an amino terminus includes an unmodified amine (ie —NH$_2$) or an amine with a substituent. For example, the amino terminus can be substituted with an acyl group to yield a carboxamide at the N-terminus. Various substituents include but are not limited to substituted acyl groups, including C$_1$-C$_6$ carbonyls, C$_7$-C$_{30}$ carbonyls, and pegylated carbamates. Representative capping groups for the N-terminus include, but are not limited to, 4-FBzl (4-fluoro-benzyl) and the following:

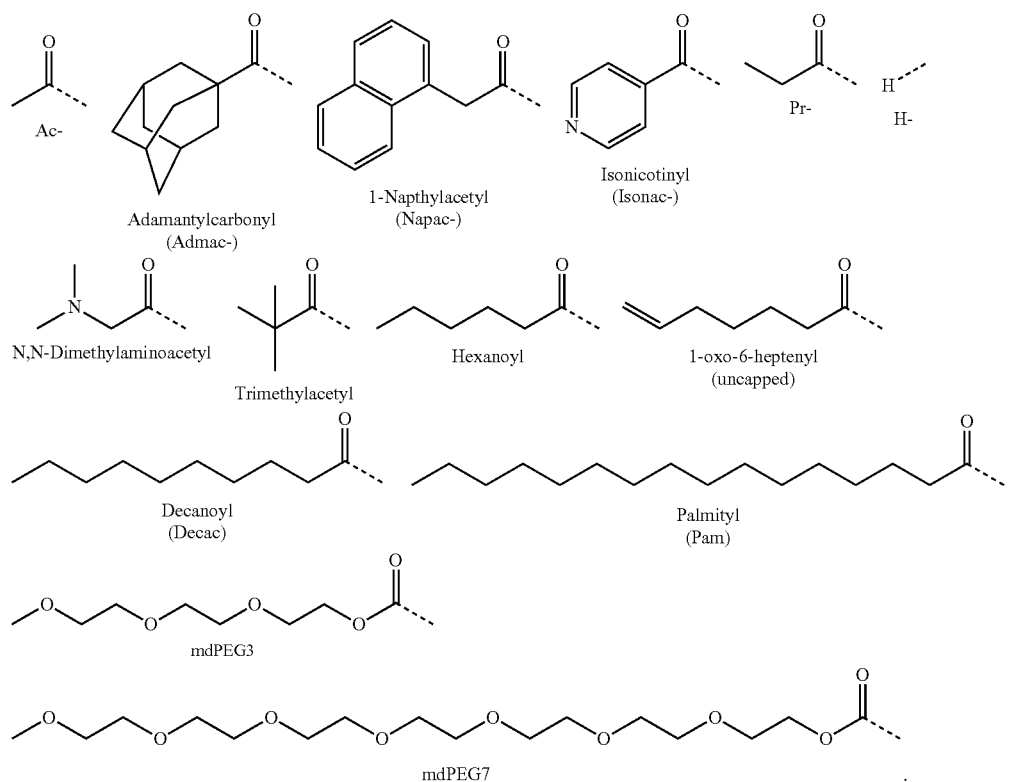

The term "member" as used herein in conjunction with macrocycles or macrocycle-forming linkers refers to the atoms that form or can form the macrocycle, and excludes substituent or side chain atoms. By analogy, cyclodecane, 1,2-difluoro-decane and 1,3-dimethyl cyclodecane are all considered ten-membered macrocycles as the hydrogen or fluoro substituents or methyl side chains do not participate in forming the macrocycle.

The symbol "⟋" when used as part of a molecular structure refers to a single bond or a trans or cis double bond.

The term "amino acid side chain" refers to a moiety attached to the α-carbon (or another backbone atom) in an amino acid. For example, the amino acid side chain for alanine is methyl, the amino acid side chain for phenylalanine is phenylmethyl, the amino acid side chain for cysteine is thiomethyl, the amino acid side chain for aspartate is carboxymethyl, the amino acid side chain for tyrosine is 4-hydroxyphenylmethyl, etc. Other non-naturally occurring amino acid side chains are also included, for example, those that occur in nature (e.g., an amino acid metabolite) or those that are made synthetically (e.g., an α,α di-substituted amino acid).

The term "α,α di-substituted amino" acid refers to a molecule or moiety containing both an amino group and a carboxyl group bound to a carbon (the α-carbon) that is attached to two natural or non-natural amino acid side chains.

The term "polypeptide" encompasses two or more naturally or non-naturally-occurring amino acids joined by a covalent bond (e.g., an amide bond). Polypeptides as described herein include full length proteins (e.g., fully processed proteins) as well as shorter amino acid sequences (e.g., fragments of naturally-occurring proteins or synthetic polypeptide fragments).

The term "first C-terminal amino acid" refers to the amino acid which is closest to the C-terminus. The term "second C-terminal amino acid" refers to the amino acid attached at the N-terminus of the first C-terminal amino acid.

The term "macrocyclization reagent" or "macrocycle-forming reagent" as used herein refers to any reagent which can be used to prepare a peptidomimetic macrocycle by mediating the reaction between two reactive groups. Reactive groups can be, for example, an azide and alkyne, in which case macrocyclization reagents include, without limitation, Cu reagents such as reagents which provide a reactive Cu(I) species, such as CuBr, CuI or CuOTf, as well as Cu(II) salts such as $Cu(CO_2CH_3)_2$, $CuSO_4$, and $CuCl_2$ that can be converted in situ to an active Cu(I) reagent by the addition of a reducing agent such as ascorbic acid or sodium ascorbate. Macrocyclization reagents can additionally include, for example, Ru reagents known in the art such as Cp*RuCl (PPh$_3$)$_2$, [Cp*RuCl]$_4$ or other Ru reagents which can provide a reactive Ru(II) species. In other cases, the reactive groups are terminal olefins. In such embodiments, the macrocyclization reagents or macrocycle-forming reagents are metathesis catalysts including, but not limited to, stabilized, late transition metal carbene complex catalysts such as Group VIII transition metal carbene catalysts. For example, such catalysts are Ru and Os metal centers having a +2 oxidation state, an electron count of 16 and pentacoordinated. In other examples, catalysts have W or Mo centers. Various catalysts are disclosed in Grubbs et al., "Ring Closing Metathesis and Related Processes in Organic Synthesis" Acc. Chem. Res. 1995, 28, 446-452, U.S. Pat. Nos. 5,811,515; 7,932,397; U.S. Application No. 2011/0065915; U.S. Application No. 2011/0245477; Yu et al., "Synthesis of Macrocyclic Natural Products by Catalyst-Controlled Stereoselective Ring-Closing Metathesis," Nature 2011, 479, 88; and Peryshkov et al., "Z-Selective Olefin Metathesis Reactions Promoted by Tungsten Oxo Alkylidene Complexes," J. Am. Chem. Soc. 2011, 133, 20754. In yet other cases, the reactive groups are thiol groups. In such embodiments, the macrocyclization reagent is, for example, a linker functionalized with two thiol-reactive groups such as halogen groups. In some examples, the macrocyclization reagent include palladium reagents, for example Pd(PPh$_3$)$_4$, Pd(PPh$_3$)$_2$Cl$_2$, Pd(dppe)Cl, Pd(dppp)Cl$_2$, and Pd(dppf)Cl$_2$. The term "halo" or "halogen" refers to fluorine, chlorine, bromine or iodine or a radical thereof.

The term "alkyl" refers to a hydrocarbon chain that is a straight chain or branched chain, containing the indicated number of carbon atoms. For example, $C_1$-$C_{10}$ indicates that the group has from 1 to 10 (inclusive) carbon atoms in it. In the absence of any numerical designation, "alkyl" is a chain (straight or branched) having 1 to 20 (inclusive) carbon atoms in it.

The term "alkylene" refers to a divalent alkyl (i.e., —R—).

The term "alkenyl" refers to a hydrocarbon chain that is a straight chain or branched chain having one or more carbon-carbon double bonds. The alkenyl moiety contains the indicated number of carbon atoms. For example, $C_2$-$C_{10}$ indicates that the group has from 2 to 10 (inclusive) carbon atoms in it. The term "lower alkenyl" refers to a $C_2$-$C_6$ alkenyl chain. In the absence of any numerical designation, "alkenyl" is a chain (straight or branched) having 2 to 20 (inclusive) carbon atoms in it.

The term "alkynyl" refers to a hydrocarbon chain that is a straight chain or branched chain having one or more carbon-carbon triple bonds. The alkynyl moiety contains the indicated number of carbon atoms. For example, $C_2$-$C_{10}$ indicates that the group has from 2 to 10 (inclusive) carbon atoms in it. The term "lower alkynyl" refers to a $C_2$-$C_6$ alkynyl chain. In the absence of any numerical designation, "alkynyl" is a chain (straight or branched) having 2 to 20 (inclusive) carbon atoms in it.

The term "aryl" refers to a 6-carbon monocyclic or 10-carbon bicyclic aromatic ring system wherein 0, 1, 2, 3, or 4 atoms of each ring are substituted by a substituent. Examples of aryl groups include phenyl, naphthyl and the like. The term "arylalkoxy" refers to an alkoxy substituted with aryl.

"Arylalkyl" refers to an aryl group, as defined above, wherein one of the aryl group's hydrogen atoms has been replaced with a $C_1$-$C_5$ alkyl group, as defined above. Representative examples of an arylalkyl group include, but are not limited to, 2-methylphenyl, 3-methylphenyl, 4-methylphenyl, 2-ethylphenyl, 3-ethylphenyl, 4-ethylphenyl, 2-propylphenyl, 3-propylphenyl, 4-propylphenyl, 2-butylphenyl, 3-butylphenyl, 4-butylphenyl, 2-pentylphenyl, 3-pentylphenyl, 4-pentylphenyl, 2-isopropylphenyl, 3-isopropylphenyl, 4-isopropylphenyl, 2-isobutylphenyl, 3-isobutylphenyl, 4-isobutylphenyl, 2-sec-butylphenyl, 3-sec-butylphenyl, 4-sec-butylphenyl, 2-t-butylphenyl, 3-t-butylphenyl and 4-t-butylphenyl.

"Arylamido" refers to an aryl group, as defined above, wherein one of the aryl group's hydrogen atoms has been replaced with one or more —C(O)NH$_2$ groups. Representative examples of an arylamido group include 2-C(O)NH$_2$-phenyl, 3-C(O)NH$_2$-phenyl, 4-C(O)NH$_2$-phenyl, 2-C(O)NH$_2$-pyridyl, 3-C(O)NH$_2$-pyridyl, and 4-C(O)NH$_2$-pyridyl, "Alkylheterocycle" refers to a $C_1$-$C_5$ alkyl group, as defined above, wherein one of the $C_1$-$C_5$ alkyl group's hydrogen atoms has been replaced with a heterocycle. Representative examples of an alkylheterocycle group include, but are not limited to, —CH$_2$CH$_2$-morpholine, —CH$_2$CH$_2$-piperidine, —CH$_2$CH$_2$CH$_2$-morpholine, and —CH$_2$CH$_2$CH$_2$-imidazole.

"Alkylamido" refers to a $C_1$-$C_5$ alkyl group, as defined above, wherein one of the $C_1$-$C_5$ alkyl group's hydrogen atoms has been replaced with a —C(O)NH$_2$ group. Representative examples of an alkylamido group include, but are not limited to, —CH$_2$—C(O)NH$_2$, —CH$_2$CH$_2$—C(O)NH$_2$, —CH$_2$CH$_2$CH$_2$C(O)NH$_2$, —CH$_2$CH$_2$CH$_2$CH$_2$C(O)NH$_2$, —CH$_2$CH$_2$CH$_2$CH$_2$CH$_2$C(O)NH$_2$, —CH$_2$CH(C(O)NH$_2$)CH$_3$, —CH$_2$CH(C(O)NH$_2$)CH$_2$CH$_3$, —CH(C(O)NH$_2$)CH$_2$CH$_3$, —C(CH$_3$)$_2$CH$_2$C(O)NH$_2$, —CH$_2$—CH$_2$—NH—C(O)—CH$_3$, —CH$_2$—CH$_2$—NH—C(O)—CH$_3$—CH$_3$, and —CH$_2$—CH$_2$—NH—C(O)—CH═CH$_2$.

"Alkanol" refers to a $C_1$-$C_5$ alkyl group, as defined above, wherein one of the $C_1$-$C_5$ alkyl group's hydrogen atoms has been replaced with a hydroxyl group. Representative examples of an alkanol group include, but are not limited to, —CH$_2$OH, —CH$_2$CH$_2$OH, —CH$_2$CH$_2$CH$_2$OH, —CH$_2$CH$_2$CH$_2$CH$_2$OH, —CH$_2$CH$_2$CH$_2$CH$_2$CH$_2$OH, —CH$_2$CH(OH)CH$_3$, —CH$_2$CH(OH)CH$_2$CH$_3$, —CH(OH)CH$_3$ and —C(CH$_3$)$_2$CH$_2$OH.

"Alkylcarboxy" refers to a $C_1$-$C_5$ alkyl group, as defined above, wherein one of the $C_1$-$C_5$ alkyl group's hydrogen atoms has been replaced with a —COOH group. Representative examples of an alkylcarboxy group include, but are not limited to, —CH$_2$COOH, —CH$_2$CH$_2$COOH, —CH$_2$CH$_2$CH$_2$COOH, —CH$_2$CH$_2$CH$_2$CH$_2$COOH, —CH$_2$CH(COOH)CH$_3$, —CH$_2$CH$_2$CH$_2$CH$_2$CH$_2$COOH, —CH$_2$CH(COOH)CH$_2$CH$_3$, —CH(COOH)CH$_2$CH$_3$ and —C(CH$_3$)$_2$CH$_2$COOH.

The term "cycloalkyl" as employed herein includes saturated and partially unsaturated cyclic hydrocarbon groups having 3 to 12 carbons, preferably 3 to 8 carbons, and more preferably 3 to 6 carbons, wherein the cycloalkyl group additionally is optionally substituted. Some cycloalkyl groups include, without limitation, cyclopropyl, cyclobutyl, cyclopentyl, cyclopentenyl, cyclohexyl, cyclohexenyl, cycloheptyl, and cyclooctyl.

The term "heteroaryl" refers to an aromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2, 3, or 4 atoms of each ring are substituted by a substituent. Examples of heteroaryl groups include pyridyl, furyl or furanyl, imidazolyl, benzimidazolyl, pyrimidinyl, thiophenyl or thienyl, quinolinyl, indolyl, thiazolyl, and the like.

The term "heteroarylalkyl" or the term "heteroaralkyl" refers to an alkyl substituted with a heteroaryl. The term "heteroarylalkoxy" refers to an alkoxy substituted with heteroaryl.

The term "heteroarylalkyl" or the term "heteroaralkyl" refers to an alkyl substituted with a heteroaryl. The term "heteroarylalkoxy" refers to an alkoxy substituted with heteroaryl.

The term "heterocyclyl" refers to a nonaromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2 or 3 atoms of each ring are substituted by a substituent. Examples of heterocyclyl groups include piperazinyl, pyrrolidinyl, dioxanyl, morpholinyl, tetrahydrofuranyl, and the like.

The term "substituent" refers to a group replacing a second atom or group such as a hydrogen atom on any molecule, compound or moiety. Suitable substituents include, without limitation, halo, hydroxy, mercapto, oxo, nitro, haloalkyl, alkyl, alkaryl, aryl, aralkyl, alkoxy, thioalkoxy, aryloxy, amino, alkoxycarbonyl, amido, carboxy, alkanesulfonyl, alkylcarbonyl, and cyano groups.

In some embodiments, the compounds disclosed herein contain one or more asymmetric centers and thus occur as racemates and racemic mixtures, single enantiomers, individual diastereomers and diastereomeric mixtures. All such isomeric forms of these compounds are included unless expressly provided otherwise. In some embodiments, the compounds disclosed herein are also represented in multiple tautomeric forms, in such instances, the compounds include all tautomeric forms of the compounds described herein (e.g., if alkylation of a ring system results in alkylation at multiple sites, the disclosure includes all such reaction products). All such isomeric forms of such compounds are included unless expressly provided otherwise. All crystal forms of the compounds described herein are included unless expressly provided otherwise.

As used herein, the terms "increase" and "decrease" mean, respectively, to cause a statistically significantly (i.e., $p<0.1$) increase or decrease of at least 5%.

As used herein, the recitation of a numerical range for a variable is intended to convey that the variable is equal to any of the values within that range. Thus, for a variable which is inherently discrete, the variable is equal to any integer value within the numerical range, including the end-points of the range. Similarly, for a variable which is inherently continuous, the variable is equal to any real value within the numerical range, including the end-points of the range. As an example, and without limitation, a variable which is described as having values between 0 and 2 takes the values 0, 1 or 2 if the variable is inherently discrete, and takes the values 0.0, 0.1, 0.01, 0.001, or any other real values $\geq 0$ and $\leq 2$ if the variable is inherently continuous.

As used herein, unless specifically indicated otherwise, the word "or" is used in the inclusive sense of "and/or" and not the exclusive sense of "either/or."

The term "on average" represents the mean value derived from performing at least three independent replicates for each data point.

The term "biological activity" encompasses structural and functional properties of a macrocycle. Biological activity is, for example, structural stability, alpha-helicity, affinity for a target, resistance to proteolytic degradation, cell penetrability, intracellular stability, in vivo stability, or any combination thereof.

The term "binding affinity" refers to the strength of a binding interaction, for example between a peptidomimetic macrocycle and a target. Binding affinity can be expressed, for example, as an equilibrium dissociation constant ("$K_D$"), which is expressed in units which are a measure of concentration (e.g. M, mM, μM, nM etc). Numerically, binding affinity and $K_D$ values vary inversely, such that a lower binding affinity corresponds to a higher $K_D$ value, while a higher binding affinity corresponds to a lower $K_D$ value. Where high binding affinity is desirable, "improved" binding affinity refers to higher binding affinity and therefore lower $K_D$ values.

The term "in vitro efficacy" refers to the extent to which a test compound, such as a peptidomimetic macrocycle, produces a beneficial result in an in vitro test system or assay. In vitro efficacy can be measured, for example, as an "$IC_{50}$" or "$EC_{50}$" value, which represents the concentration of the test compound which produces 50% of the maximal effect in the test system.

The term "ratio of in vitro efficacies" or "in vitro efficacy ratio" refers to the ratio of $IC_{50}$ or $EC_{50}$ values from a first assay (the numerator) versus a second assay (the denominator). Consequently, an improved in vitro efficacy ratio for Assay 1 versus Assay 2 refers to a lower value for the ratio expressed as $IC_{50}$ (Assay 1)/$IC_{50}$ (Assay 2) or alternatively as $EC_{50}$ (Assay 1)/$EC_{50}$ (Assay 2). This concept can also be characterized as "improved selectivity" in Assay 1 versus Assay 2, which can be due either to a decrease in the $IC_{50}$ or $EC_{50}$ value for Target 1 or an increase in the value for the $IC_{50}$ or $EC_{50}$ value for Target 2.

"Micelle forming agent" as used herein can be an amphiphilic compound meaning a compound that contains both hydrophobic groups (tails) and hydrophilic groups (heads). Micelle forming agents include surfactant, for examples ionic, non-ionic, and zwitterionic surfactants.

The details of one or more particular embodiments of the invention are set forth in the accompanying drawings and the description below. Other features, objects, and advantages of the invention will be apparent from the description and drawings, and from the claims.

The term "Xaa" is used in the Formulas described herein to refer to any amino acids. This term can sometimes be followed by a number subscript, for e.g. "$Xaa_6$." The number subscript in these cases may or may not refer to the position of the amino acids "Xaa" in a sequence. For example in some but not all cases $Xaa_6$ can mean that the amino acid "Xaa" is present at the sixth position in a sequence.

Overview

In one aspect the disclosure provides aqueous pharmaceutical formulations, for parenteral administration, comprising peptidomimetic macrocycle or a pharmaceutically acceptable salt thereof, wherein the peptidomimetic macrocycle binds to MDM2 and/or MDMX proteins. The aqueous pharmaceutical formulations provided herein are aqueous solution ready for injection (for example intravenously) or aqueous concentrations ready for dilution and injection. In some embodiments, the aqueous pharmaceutical formulations disclosed herein do not contain micelles or are essentially free of micelles. In various embodiments, the aqueous pharmaceutical formulations disclosed herein comprise less than 2% w/v of a micelle forming agent. In some examples the aqueous pharmaceutical formulations disclosed herein comprise less than 2%, 1.9%, 1.8%, 1.7%, 1.6%, 1.5%, 1.4%, 1.3%, 1.2%, 1.1%, 1.0%, 0.9%, 08%, 0.7%, 0.6%, 0.5%, 0.4%, 0.3%, 0.2%, 0.1%, 0.09%, 0.08%, 0.07%, 0.06%, or 0.05% w/v of a micelle forming agent. In some embodiments, the micelle forming agent is sorbitol. In some embodiments, the micelle forming agent is polyethylene glycol-poly(lactic acid). In some embodiments, the micelle forming agent is 1,2-distearoyl-phosphatidylethanolamine-methyl-polyethyleneglycol conjugate. In some embodiments, no micelle forming agent is used, yet the molecule has micelle forming properties.

The aqueous pharmaceutical formulations comprise an aqueous diluent. In some examples, the diluent is water, purified water, water for injection, bacteriostatic water for injection, sterile water for injection, water for parenterals, PBS, and/or, sterile water for irrigation. In some embodiments, the diluent is water for injection. In some embodiments, the diluent is PBS. In some embodiments, the diluent is a solution of dextrose in water, for example 5% dextrose in water.

In various embodiments, the peptidomimetic macrocycle is a cross-linked peptide comprising at least one macrocycle-forming linker which forms a macrocycle between a first amino acid residue (or analog) and a second amino acid residue. In some embodiments, a peptidomimetic macrocycle has the Formula (I):

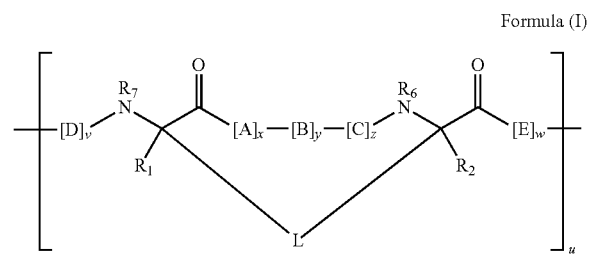

Formula (I)

wherein:
each A, C, and D is independently an amino acid;
each B is independently an amino acid,

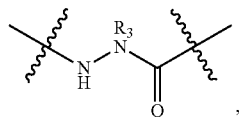

[—NH-$L_3$-CO—], [—NH-$L_3$-$SO_2$—], or [—NH-$L_3$-];
each E is independently an amino acid selected from the group consisting of Ala (alanine), D-Ala (D-alanine), Aib (α-aminoisobutyric acid), Sar (N-methyl glycine), and Ser (serine);
each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo; or forms a macrocycle-forming linker L' connected to the alpha position of one of said D or E amino acids;
each $R_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;
each L and L' is independently a macrocycle-forming linker;
each L3 is independently alkylene, alkenylene, alkynylene, heteroalkylene, cycloalkylene, heterocycloalkylene, cycloarylene, heterocycloarylene, or [—$R_4$—K—$R_4$-]$_n$, each being optionally substituted with $R_5$;
each $R_4$ is independently alkylene, alkenylene, alkynylene, heteroalkylene, cycloalkylene, heterocycloalkylene, arylene, or heteroarylene;
each K is independently O, S, SO, $SO_2$, CO, $CO_2$, or $CONR_3$;
each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;
each $R_6$ is independently —H, alkyl, alkenyl, alkynyl, arylalkyl, cycloalkylalkyl, heterocycloalkyl, a fluorescent moiety, a radioisotope or a therapeutic agent;
each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;
each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;
each v is independently an integer from 1-1000;
each w is independently an integer from 3-1000;
u is an integer from 1-10;
each x, y and z is independently an integer from 0-10; and
each n is independently an integer from 1-5.

In some embodiments, the macrocycle-forming linker (L or L') has a formula -$L_1$-$L_2$-, wherein $L_1$ and $L_2$ are independently alkylene, alkenylene, alkynylene, heteroalkylene, cycloalkylene, heterocycloalkylene, cycloarylene, heterocycloarylene, or [—$R_4$—K—$R_4$-]$_n$, each being optionally substituted with $R_5$;
each $R_4$ is independently alkylene, alkenylene, alkynylene, heteroalkylene, cycloalkylene, heterocycloalkylene, arylene, or heteroarylene;
each K is independently O, S, SO, $SO_2$, CO, $CO_2$, or $CONR_3$; and
each $R_3$ independently is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;
each n is an integer from 1-5.

In some embodiments the peptidomimetic macrocycle is a p53-based peptidomimetic macrocycle capable of binding to and modulating the activity of p53, MDM2 and/or MDMX. In some embodiments the peptidomimetic macrocycle is a p53-based peptidomimetic macrocycle that inhibits the interactions between p53, MDM2 and/or MDMX proteins. In some embodiments the peptidomimetic macrocycle is a p53-based peptidomimetic macrocycle that can be used for treating diseases including but not limited to cancer and other hyperproliferative diseases. In some examples, the peptidomimetic macrocycle has a Formula I and comprises an amino acid sequence which is at least about 60%, 65%, 70%, 75%, 80%, 85%, 90%, 95%, 99% or more identical to an amino acid sequence in any of Table 1, Table 1a, Table 1b, and Table 1c. In some examples, the peptidomimetic macrocycle in a peptidomimetic macrocycle from the any of Table 1, Table 1a, Table 1b, and Table 1c.

Any suitable dosage of peptidomimetic macrocycles can be formulated in the aqueous pharmaceutical formulations of the present disclosure. Generally, the peptidomimetic macrocycle (or, in embodiments comprising two or more peptidomimetic macrocycles, each of the peptidomimetic macrocycle) is present in the aqueous pharmaceutical formulation in an amount greater than or equal to 1 mg/mL. For example greater than or equal to 5 mg/mL, 10 mg/mL, 15 mg/mL, 20 mg/mL, 30 mg/mL, 40 mg/mL, and 50 mg/mL. In some examples, the peptidomimetic macrocycle is present in the aqueous pharmaceutical formulation in an amount ranging from about 15 mg/mL to about 100 mg/mL. In some embodiments, the peptidomimetic macrocycle is present in the aqueous pharmaceutical formulation in an amount ranging from about 15 mg/mL to about 60 mg/mL. In some embodiments, the peptidomimetic macrocycle is present in the aqueous pharmaceutical formulation in an amount ranging from about 20 mg/mL to about 50 mg/mL. In some embodiments, the peptidomimetic macrocycle is present in the aqueous pharmaceutical formulation in an amount ranging from about 50 mg/mL to about 100 mg/mL. In some embodiments, the peptidomimetic macrocycles is present in the aqueous pharmaceutical formulation in an amount ranging from about 15 mg/mL to about 20 mg/mL. In some embodiments, the peptidomimetic macrocycles is present in the aqueous pharmaceutical formulation in an amount ranging from about 15 mg/mL to about 30 mg/mL. It will be readily apparent to those of skill that the peptidomimetic macrocycle dosage can be varied depending on several conditions including the peptidomimetic macrocycle used, the subject to be treated, and the disease, disorder or condition to be treated.

The aqueous pharmaceutical formulations disclosed herein can additionally comprise a buffering agent. The buffering agent can be any agent capable of maintaining the pH of the aqueous formulation in the range of 4.0-9.0. For example, the buffering agent is selected from a group consisting of ammonia solution, calcium carbonate, tribasic calcium phosphate, citric acid monohydrate, dibasic sodium phosphate, diethanolamine, malic acid, monobasic sodium phosphate, monoethanolamine, monosodium glutamate, phosphoric acid, potassium citrate, sodium acetate, sodium bicarbonate, sodium borate, sodium citrate dehydrate, sodium hydroxide, sodium lactate and triethanolamine. In some embodiments, the buffering agent can be monobasic sodium phosphate, dibasic sodium phosphate, or a mixture thereof. The pH of the formulation can be in the range of 4.0-9.0. For example, the pH can be in the range of about 4.5-8.5, about 5.0-8.0, about 5.5-7.5, about 7.0-7.5, about 7.0-8.0, about 7.0-9.0, or about 8.0-9.0. In some embodiments, the pH of the formulations is about 7.0. In some embodiments, the pH of the formulations is about 7.5. In some embodiments, the pH of the formulations is about 8.0.

The aqueous pharmaceutical formulations disclosed herein can comprise a stabilizing agent. The stabilizing agent can be any pharmaceutically acceptable stabilizing agent. Such stabilizing agent can include, for example antioxidants and/or surfactants. In some embodiments, the stabilizing agent is a non-ionic stabilizing agent, for example as non-ionic surfactant. In some embodiments, the stabilizing agent is a fatty acid ester. The stabilizing agent can be selected from a group consisting of polyoxyethylene glycol alkyl ethers, polyoxypropylene glycol alkyl ethers, glucoside alkyl ethers, polyoxyethylene glycol octylphenol ethers, polyoxyethylene glycol alkylphenol ethers, glycerol alkyl esters, polyoxyethylene glycol sorbitan alkyl esters, sorbitan alkyl esters, cocamide MEA, cocamide DEA, dodecyldimethylamine oxide, block copolymers of polyethylene glycol and polypropylene glycol, and polyethoxylated tallow amine. In some examples, the stabilizing agent is a polyoxyethylene sorbitan fatty acid ester, for example polysorbate 20, polysorbate 21, polysorbate 40, polysorbate 60, polysorbate 61, polysorbate 65, polysorbate 80, polysorbate 81, polysorbate 85 or polysorbate 120.

In some embodiments, the tonicity of the instant aqueous pharmaceutical formulations can be adjusted, for example the tonicity of the formulations can be such that the formulations are isotonic with the physiologic fluid. Such formulations can further comprise one or more tonicity adjusting agent (tonicity agent) to adjust the tonicity of the formulations. Any pharmaceutically acceptable tonicity agent can be used. In some examples the tonicity agents are selected from a group consisting of electrolytes, monosaccharides, disaccharides, polysaccharides, and water-soluble glucans. In some examples the tonicity agent in NaCl or KCl. In some examples the tonicity agent is selected from a group consisting of fructose, glucose, mannose, mannitol, sorbose, xylose, maltose, lactose, sucrose, trehalose, dextran, pullulan, dextrin, cyclodextrin, soluble starch, hydroxyethyl starch and carboxymethylcellulose. In some embodiments, the tonicity agent is trehalose.

In some examples, the formulations of the present disclosure further comprise one or more additional excipients. For example a preservative or a co-solvent.

Also provided herein are methods of making the aqueous pharmaceutical formulations disclosed herein. The method comprises adding a peptidomimetic macrocycle or a pharmaceutically acceptable salt thereof to an aqueous solution. The aqueous solution can comprise one or more of a buffering agent, a stabilizing agent, and a tonicity agent. The method can further comprise adding a pH adjusting agent to maintain the pH of the mixture at a specified level. In some embodiments, the method comprises adding a desired amount of the peptidomimetic macrocycle or a pharmaceutically acceptable salt (for example sodium, potassium or lithium salt) thereof to water. In some embodiments, the method comprises adding a desired amount of the peptidomimetic macrocycle or a pharmaceutically acceptable salt thereof to an aqueous solution comprising a buffering agent, a stabilizing agent, and a tonicity agent.

Also provided herein is a method for treating a disease, condition or disorder that can be treated, alleviated, or prevented by administering to a subject an aqueous pharmaceutical formulation as described herein. The method comprises, administering to the subject the aqueous pharmaceutical formulation in an amount effective to treat, alleviate or prevent the disease, condition, or disorder. In some embodiments, the disease, condition, or disorder is a p53 mediated disease, condition, or disorder. In some embodiments, the disease, condition, or disorder is a MDM2 and/or MDMX mediated disease, condition, or disorder. In some embodiments, the disease, condition, or disorder is a hyperproliferative disease and/or an inflammatory disorder. In some embodiments, the disease, condition, or disorder is cancers and neoplastic conditions. In some examples, the cancer is selected from a group consisting of pancreatic cancer, bladder cancer, colon cancer, liver cancer, colorectal cancer, breast cancer, prostate cancer, renal cancer, hepatocellular cancer, lung cancer, ovarian cancer, cervical cancer, gastric cancer, esophageal cancer, head and neck cancer, melanoma, neuroendocrine cancers, CNS cancers, brain tumors, bone cancer, skin cancer, ocular tumor, rectal cancer, choriocarcinoma (tumor of the placenta), sarcoma and soft tissue cancer, testicular cancer, gall bladder cancer, and biliary cancer. In some examples, the cancer is selected from a group consisting of bladder cancer, bone cancer, breast cancer, cervical cancer, CNS cancer, colon cancer, ocular tumor, renal cancer, liver cancer, lung cancer, pancreatic cancer, choriocarcinoma (tumor of the placenta), prostate cancer, sarcoma, skin cancer, soft tissue cancer, gastric cancer, gall bladder cancer, biliary cancer, renal cancer, neoblastoma, or neuroendocrine cancer. Non-limiting examples of ocular tumor include choroidal nevus, choroidal melanoma, choroidal metastasis, choroidal hemangioma, choroidal osteoma, iris melanoma, uveal melanoma, melanocytoma, metastasis retinal capillary hemangiomas, congenital hypertrophy of the RPE, RPE adenoma or retinoblastoma. In some cases, the cancer is selected from non-small cell lung cancer, small-cell lung cancer, colon cancer, CNS cancer, melanoma, ovarian cancer, renal cancer, prostate cancer and breast cancer. In some examples, the cancer is breast cancer. In some examples, the cancer is gall bladder cancer. In some examples, the cancer is biliary cancer. In some examples, the cancer is neuroendocrine cancer. In some examples, the cancer is bone cancer. In some examples, the cancer is the bone cancer is osteosarcoma. In some examples, the cancer is skin cancer. In some examples, the cancer is melanoma.

In another aspect, the present disclosure provides kits for treating a disease, condition or disorder, wherein the kit comprises the aqueous pharmaceutical disclosed herein. The formulations can be packaged in any suitable container, for example a bottle or a vial. In some examples, the formulations can be packed in glass serum vial. In some examples, the formulations can be packed in serum vials composed of borosilicate glass. In some examples, the formulations are packed in a 1 mL, a 2 mL, a 3 mL, a 4 mL, a 5 mL, a 10 mL, a 20 mL, a 30 mL, or a 50 mL glass vial. The bottles and/or vials can be equipped with stoppers and/or seals. For example, the formulations can be packaged into glass vials equipped with Teflon stoppers and/or a flip-off cap. The flip-off cap can be a plastic cap. The glass container can be an ampoule. The formulations can be packaged in multidose form or in single dose form. In some cases, the formulations are packaged in multidose forms. In some embodiments the formulations are packaged as single dose units. In some embodiments, the kit further comprises instructions, wherein the instructions direct the administration of the formulation to treat the subject in need thereof. The kit can also include a device for administration of the formulation.

Aqueous Pharmaceutical Formulations of Peptidomimetic Macrocycles for Parenteral Administration In one aspect, the disclosure provides aqueous pharmaceutical formulations, suitable for parenteral administration, comprising peptidomimetic macrocycles, as described herein and an aqueous diluent. The aqueous pharmaceutical formulations provided herein can be suitable for intravenous, intra-arterial, intrathecal, or subcutaneous administration. In some embodiments, the aqueous pharmaceutical formulations are suitable for intravenous administration. The aqueous pharmaceutical formulations described herein can provide improved solubility and/or stability of the peptidomimetic macrocycle. In particular embodiments, the aqueous pharmaceutical formulations provide increased solubility of the peptidomimetic macrocycles compared to the solubility of the peptidomimetic macrocycles peptide in water alone.

In some examples, the aqueous diluent is water, purified water, water for injection, bacteriostatic water for injection, sterile water for injection, water for parenterals, sterile water for irrigation, various sterile solution of electrolytes and or dextrose. In some embodiments, the diluent is a pH buffered solution (e.g. phosphate-buffered saline), sterile saline solution, Ringer's solution or dextrose solution. In some embodiments, the diluent is water for injection. In some embodiments, the diluent is a solution of dextrose in water, for example 5% dextrose in water.

The aqueous pharmaceutical formulations my further comprise a co-solvent. A co-solvent is any solvent that facilitates/enhances the solubility of the peptidomimetic macrocycles (or of the one or more excipients) in the aqueous diluent. The co-solvent is preferably water miscible. In some embodiments, the co-solvent is ethyl alcohol, glycerin, polyethylene glycol, or propylene glycol. In some embodiments, the co-solvent is dimethyl sulfoxide (DMSO), N-methylpyrrolidone (NMP), dimethylacetamide (DMA) or a combination thereof.

The aqueous pharmaceutical formulations provided herein are aqueous solution ready for injection (for example intravenously) or aqueous concentrations ready for dilution and injection. In some embodiments, the aqueous pharmaceutical formulations disclosed herein do not contain micelles or are essentially free of micelles. In various embodiments, the aqueous pharmaceutical formulations disclosed herein comprise less than 2% w/v of a micelle forming agent. In some examples the aqueous pharmaceutical formulations disclosed herein comprise less than 2%, 1.9%, 1.8%, 1.7%, 0.6%, 1.5%, 1.4%, 1.3%, 1.2%, 1.1%, 1.0%, 0.9%, 08%, 0.7%, 0.6%, 0.5%, 0.4%, 0.3%, 0.2%, 0.1%, 0.09%, 0.08%, 0.07%, 0.06%, or 0.05% w/v of a micelle forming agent. In some examples the aqueous pharmaceutical formulations disclosed herein comprise 0.0001%-2%, 0.0005%-2%, 0.001%-2%, 0.005%-2%, 0.01%-2%, 0.05%-2%, 0.1%-2%, 0.2%-2%, 0.3%-2%, 0.4%-2%, 0.5%-2%, 0.6%-2%, 0.7%-2%, 0.8%-2%, 0.9%-2%, 1.0%-2%, 1.1%-2%, 1.2%-2%, 1.3%-2%, 1.4%-2%, 1.5%-2%, 1.6%-2%, 1.7%-2%, 1.8%-2%, 1.9%-2%, 0.0001%4.8%, 0.0005%4.8%, 0.001%-1.8%, 0.005%-1.8%, 0.01%-1.8%, 0.05%-1.8%, 0.1%-1.8%, 0.2%4.8%, 0.3%-1.8%, 0.4%-1.8%, 0.5%-1.8%, 0.6%-1.8%, 0.7%-1.8%, 0.8%-1.8%, 0.9%-1.8%, 1.0%-1.8%, 1.1%-1.8%, 1.2%-1.8%, 1.3%-1.8%, 1.4%-1.8%, 1.5%-1.8%, 1.6%-1.8%, 0.0001%-1.6%, 0.0005%-1.6%, 0.001%4.6%, 0.005%-1.6%, 0.01%-1.6%, 0.05%-1.6%, 0.1%-1.6%, 0.2%-1.6%, 0.3%-1.6%, 0.4%-1.6%, 0.5%-1.6%, 0.6%4.6%, 0.7%-1.6%, 0.8%-1.6%, 0.9%-1.6%, 1.0%4.6%, 1.1%-1.6%, 1.2%-1.6%, 1.3%-1.6%, 1.4%-1.6%, 1.5%-1.6%, 0.0001%-1.4%, 0.0005%4.4%, 0.001%-1.4%, 0.005%-1.4%, 0.01%-1.4%, 0.05%-1.4%, 0.1%-1.4%, 0.2%-1.4%, 0.3%-1.4%, 0.4%-1.4%, 0.5%-1.4%, 0.6%4.4%, 0.7%-1.4%, 0.8%-1.4%, 0.9%-1.4%, 1.0%-1.4%, 1.1%-1.4%, 1.2%-1.4%, 1.3%-1.4%, 0.0001%-1.2%, 0.0005%4.2%, 0.001%-1.2%, 0.005%-1.2%, 0.01%-1.2%, 0.05%-1.2%, 0.1%-1.2%, 0.2%-1.2%, 0.3%-1.2%, 0.4%-1.2%, 0.5%-1.2%, 0.6%-1.2%, 0.7%-1.2%, 0.8%-1.2%, 0.9%-1.2%, 1.0%-1.2%, 1.1%-1.2%, 0.0001%-1%, 0.0005%-1%, 0.001%-1%, 0.005%-1%, 0.01%4%, 0.05%-1%, 0.1%4%, 0.2%-1%, 0.3%-1%, 0.4%-1%, 0.5%4%, 0.6%-1%, 0.7%4%, 0.0001%-0.8%, 0.0005%-0.8%, 0.001%-0.8%, 0.005%-0.8%, 0.01%-0.8%, 0.05%-0.8%, 0.1%-0.8%, 0.2%-0.8%, 0.3%-0.8%, 0.4%-0.8%, 0.5%-0.8%, 0.6%-0.8%, 0.7%-0.8%, 0.0001%-0.6%, 0.0005%-0.6%, 0.001%-0.6%, 0.005%-0.6%, 0.01%-0.6%, 0.05%-0.6%, 0.1%-0.6%, 0.2%-0.6%, 0.3%-0.6%, 0.4%-0.6%, 0.5%-0.6%, 0.0001%-0.4%, 0.0005%-0.4%, 0.001%-0.4%, 0.005%-0.4%, 0.01%-0.4%, 0.05%-0.4%, 0.1%-0.4%, 0.2%-0.4%, 0.3%-0.4%, 0.0001%-0.2%, 0.0005%-0.2%, 0.001%-0.2%, 0.005%-0.2%, 0.01%-0.2%, 0.05%-0.2%, 0.1%-0.2%, 0.0001%-0.1%, 0.0005%-0.1%, 0.001%-0.1%, 0.005%-0.1%, 0.01%-0.1%, 0.05%-0.1, 0.0001%-0.05%, 0.0005%-0.05%, 0.001%-0.05%, 0.005%-0.05%, 0.01%-0.05%, 0.0001%-0.01%, 0.0005%-0.01%, 0.001%-0.01%, 0.005%-0.01%, 0.0001%-0.005%, 0.0005%-0.005%, 0.001%-0.005%, 0.0001%-0.001%, 0.0005%-0.001%, or 0.0001%-0.0005% w/v of a micelle forming agent. In some embodiments, the micelle forming agent is sorbitol. In some embodiments, the micelle forming agent is Polyethylene glycol-Poly(lactic acid). In some embodiments, the micelle forming agent is 1,2-Distearoyl-phosphatidylethanolamine-methyl-polyethyleneglycol conjugate. In some embodiments, no micelle-forming agent is added in the formulation, but the molecule has micelle-forming properties.

The aqueous pharmaceutical formulations disclosed herein can additionally comprise one or more excipients suitable for aqueous pharmaceutical formulations. Exemplary excipients that can be present in the aqueous pharmaceutical formulations described herein are described below.

Buffering Agents

The aqueous pharmaceutical formulation of the disclosure can comprise one or more buffering agent, for example a pharmaceutically acceptable buffering agent. Buffering agent can be used to control pH of the formulation and/or to maintain stability of the peptidomimetic macrocycle. The pH range of the aqueous pharmaceutical formulation can be pH 2 to pH 12, pH 4 to pH 9, pH 5 to pH9, or pH 6 to pH 8. In some embodiments the aqueous solution is buffered to a pH of about 5.0-9.0. In some embodiments the aqueous pharmaceutical formulation is buffered to a pH of about 6.0-8.0. In some embodiments the pH of the aqueous pharmaceutical formulation is in the range of about 6.5-8.0, about 7.0-8.0, about 7.5-8.0, about 6.0-7.5, about 6.5-7.5, about 7.0-7.5, 6.0-7.0, about 6.5-7.0, about 7.0-7.5, or about 7.5-8.0. In some embodiments the aqueous solution is buffered to a pH of about 6.0, about 6.5, about 7.0, about 7.5, about 8.0 or about 8.5. In some embodiments the aqueous pharmaceutical formulation is buffered to a pH of about 7.0, about 7.1, about 7.2, about 7.3, about 7.4, about 7.5, about 7.6, about 7.7, about 7.8, about 7.9, or about 8.0. In some embodiments the aqueous pharmaceutical formulation is buffered to a pH of about 7.3-7.5.

Any buffering that can be safe for injection into mammalian tissue, particularly into humans, can be used in the pharmaceutical formulation of the disclosure. Buffering agent can be any agent capable of driving an acidic or basic solution to a certain pH state, and then preventing a change from that state. Buffering agents that can be used in the instant aqueous pharmaceutical formulations include citrate, acetate, phosphate, maleate, tartrate, borate, carbonate, bicarbonate, succinate, or glutamate buffers.

In some examples, the buffering agent is lithium lactate, magnesium lactate, sodium lactate, potassium lactate, calcium lactate, lithium phosphate, sodium phosphate, potassium phosphate, calcium phosphate, sodium polyphosphate, potassium polyphosphate, sodium pyrophosphate, potassium pyrophosphate, disodium hydrogenphosphate, dipotassium hydrogenphosphate, trisodium phosphate, tripotassium phosphate, potassium metaphosphate, lithium maleate, sodium maleate, potassium maleate, calcium maleate, lithium tartarate, sodium tartarate, potassium tartarate, calcium tartarate, lithium succinate, sodium succinate, potassium succinate, calcium succinate, lithium acetate, sodium acetate, potassium acetate, calcium acetate, sodium bicarbonate, potassium bicarbonate, magnesium hydroxide, magnesium glucomate, aluminum hydroxide, aluminum hydroxide/sodium bicarbonate coprecipitate, sodium citrate, sodium tartarate, sodium carbonate, magnesium oxide, magnesium hydroxide, magnesium carbonate, magnesium silicate, calcium glycerophosphate, calcium chloride, calcium hydroxide, calcium lactate, calcium carbonate, calcium bicarbonate, or mixture thereof.

In some examples, the buffering agent is a citrate buffer. Non-limiting examples of suitable citrate buffers include lithium citrate monohydrate, sodium citrate monohydrate, potassium citrate monohydrate, calcium citrate monohydrate, lithium citrate dihydrate, sodium citrate dihydrate, potassium citrate dihydrate, calcium citrate dihydrate, lithium citrate trihydrate, sodium citrate trihydrate, potassium citrate trihydrate, calcium citrate trihydrate, lithium citrate tetrahydrate, sodium citrate tetrahydrate, potassium citrate tetrahydrate, calcium citrate tetrahydrate, lithium citrate pentahydrate, sodium citrate pentahydrate, potassium citrate pentahydrate, calcium citrate pentahydrate, lithium citrate hexahydrate, sodium citrate hexahydrate, potassium citrate hexahydrate, calcium citrate hexahydrate, lithium citrate heptahydrate, sodium citrate heptahydrate, potassium citrate heptahydrate, or calcium citrate heptahydrate.

In some examples, the buffering agent is a phosphate buffer. Non-limiting examples of suitable phosphate buffering agents that can be used in the formulations of the instant disclosure include, without limitation, monobasic sodium phosphate, dibasic sodium phosphate, monobasic potassium phosphate, dibasic potassium phosphate, sodium pyrophosphate, potassium pyrophosphate, disodium hydrogenphosphate, dipotassium hydrogenphosphate, potassium metaphosphate, calcium phosphate, tribasic, calcium phosphate, dibasic anhydrous, calcium phosphate dibasic, hydrate, In one embodiment, the buffering agent is a phosphate buffer. In one embodiment buffering agent is $NaH_2PO_4$. In one embodiment, the buffering agent is $Na_2HPO_4$. In one embodiment the buffering agent is a mixture of $NaH_2PO_4$ and $Na_2HPO_4$. In one embodiment buffering agent is $KH_2PO_4$. In one embodiment, the buffering agent is $K_2HPO_4$. In one embodiment the buffering agent is a mixture of $KH_2PO_4$ and $K_2HPO_4$.

Tonicity Adjusting Agents

The aqueous pharmaceutical formulations disclosed herein can comprise one or more tonicity adjusting agents in order to adjust the tonicity/osmolarity of the formulations. For example, the tonicity/osmolarity of the aqueous pharmaceutical formulations can be adjusted to be isotonic with human plasma. This can help to avoid damage to the tissues. In various embodiments, the osmolarity of the aqueous pharmaceutical formulations disclosed herein can be in the range of 250 to 1000 mOsM. For example, the osmolarity of the formulations can be about 250-300 mOsM, 250-350 mOsM, 250-400 mOsM, 250-450 mOsM, 250-500 mOsM, 250-550 mOsM, 250-600 mOsM, 250-650 mOsM, 250-700 mOsM, 250-750 mOsM, 250-800 mOsM, 250-850 mOsM, 250-900 mOsM, 250-950 mOsM, 300-350 mOsM, 300-400 mOsM, 300-450 mOsM, 300-500 mOsM, 300-550 mOsM, 300-600 mOsM, 300-650 mOsM, 300-700 mOsM, 300-750 mOsM, 300-800 mOsM, 300-850 mOsM, 300-900 mOsM, 300-950 mOsM, 300-1000 mOsM, 350-400 mOsM, 350-450 mOsM, 350-500 mOsM, 350-550 mOsM, 350-600 mOsM, 350-650 mOsM, 350-700 mOsM, 350-750 mOsM, 350-800 mOsM, 350-850 mOsM, 350-900 mOsM, 350-950 mOsM, 350-1000 mOsM, 400-450 mOsM, 400-500 mOsM, 400-550 mOsM, 400-600 mOsM, 400-650 mOsM, 400-700 mOsM, 400-750 mOsM, 400-800 mOsM, 400-850 mOsM, 400-900 mOsM, 400-950 mOsM, 400-1000 mOsM, 450-500 mOsM, 450-550 mOsM, 450-600 mOsM, 450-650 mOsM, 450-700 mOsM, 450-750 mOsM, 450-800 mOsM, 450-850 mOsM, 450-900 mOsM, 450-950 mOsM, 450-1000 mOsM, 500-550 mOsM, 500-600 mOsM, 500-650 mOsM, 500-700 mOsM, 500-750 mOsM, 500-800 mOsM, 500-850 mOsM, 500-900 mOsM, 500-950 mOsM, 500-1000 mOsM, 550-600 mOsM, 550-650 mOsM, 550-700 mOsM, 550-750 mOsM, 550-800 mOsM, 550-850 mOsM, 550-900 mOsM, 550-950 mOsM, 550-1000 mOsM, 600-650 mOsM, 600-700 mOsM, 600-750 mOsM, 600-800 mOsM, 600-850 mOsM, 600-900 mOsM, 600-950 mOsM, 600-1000 mOsM, 650-700 mOsM, 650-750 mOsM, 650-800 mOsM, 650-850 mOsM, 650-900 mOsM, 650-950 mOsM, 650-1000 mOsM, 700-750 mOsM, 700-800 mOsM, 700-850 mOsM, 700-900 mOsM, 700-950 mOsM, 700-1000 mOsM, 750-800 mOsM, 750-850 mOsM, 750-900 mOsM, 750-950 mOsM, 750-1000 mOsM, 800-850 mOsM, 800-900 mOsM, 800-950 mOsM, 800-1000 mOsM, 850-900 mOsM, 850-950 mOsM, 850-1000 mOsM, 900-950 mOsM, 900-1000 mOsM, or 950-1000 mOsM. In some embodiments, the osmolarity of the formulations is in the range of 250 to 450 mOsM. For example the osmolarity of the formulations can be about 250 mOsM, about 300 mOsM, about 350 mOsM, about 400 mOsM, or about 450 mOsM. In some embodiments, the formulation is isotonic with biologic fluids, i.e., the osmolarity is about 300 mOsM.

The tonicity adjusting agents can be ionic tonicity adjusting agents or non-ionic tonicity adjusting agents. In some embodiments, the isotonic agent is an ionic-isotonic agent. In some embodiments, the isotonic agent is a non-ionic isotonic agent. In some embodiments, the isotonic agent is a mixture of one or more ionic and/or non-ionic isotonic agent. In a some embodiment of the disclosure the isotonic agent is selected from the group consisting of a salt (e.g. sodium chloride, boric acid, sodium nitrate, potassium nitrate), a sugar or sugar alcohol, an amino acid (e.g. L-glycine, L-histidine, arginine, lysine, isoleucine, aspartic acid, tryptophan, threonine), an alditol (e.g. glycerol (glycerine), 1,2-propanediol (propyleneglycol), 1,3-propanediol, 1,3-butanediol, polyethyleneglycol (e.g. PEG400), or mixtures thereof. Any sugar such as mono-, di-, or polysaccharides, or water-soluble glucans, including for example fructose, glucose, mannose, sorbose, xylose, maltose, lactose, sucrose, trehalose, dextran, pullulan, dextrin, cyclodextrin, soluble starch, hydroxyethyl starch and carboxymethylcellulose-Na can be used. In some examples, the tonicity adjusting agent is selected from a group consisting of dextrose, glycerin, mannitol, trehalose, potassium chloride and sodium chloride. In some example, the tonicity adjusting agent is trehalose, for example D-trehalose. In some example, the tonicity adjusting agent is sodium chloride. In some example, the tonicity adjusting agent is potassium chloride. The use of an tonicity adjusting agent in aqueous pharmaceutical formulations is well-known to the skilled person. For convenience reference is made to Remington: *The Science and Practice of Pharmacy*, 19$^{th}$ edition, 1995.

Stabilizing Agent

The aqueous pharmaceutical formulations described herein comprise a stabilizing agent. Non-limiting examples of stabilizing agents that can be used include acacia, agar, albumin, alginic acid, aluminum stearate, ammonium alginate, arabinose, arginine HCL, ascorbic acid, ascorbyl palmitate, bentonite, butylated hydroxytoluene, calcium alginate, calcium stearate, carboxymethylcellulose calcium, carboxymethylcellulose sodium, carrageenan, cellobiose, cellulose *ceratonia*, colloidal silicon dioxide, cyclodextrins, diethanolamine, dextran, edentates, ethylcellulose, ethylene glycol palmitostearate, fructose, gentiobiose, glucose, glucosamine, glycine, glycerin monostearate, hydroxypropyl cellulose, hydroxyethyl starch, hypromellose, hyaluronic acid, invert sugar, isomaltose, lactose, lecithin, magnesium aluminum silicate, mannose, mannitol, maltose, mineral oil and lanolin alcohols, monoethanolamine, N-methyl pyrollidone, pectin, polacrilin potassium, poloxamer (for example poloxamer 124, poloxamer 188, poloxamer 237, poloxamer 338, or poloxamer 407), polyoxyethylene sobitan fatty acid esters, polyvinyl alcohol, potassium alginate, potassium chloride, povidone (for example povidone K-12, povidone K-15, povidone K-17, povidone K-25, povidone K-20, povidone K-60, povidone K-90, or povidone K-120), propyl gallate, propylene glycol, propylene glycol alginate, raffinose, sodium acetate, sodium alginate, sodium borate, sodium chloride, sodium stearyl fumarate, sorbitol, stearyl alcohol, sucrose, sulfobutylether β-cyclodextrin, starch, trehalose, white wax, xanthan gum, xylitol, yellow wax and zinc acetate.

In some embodiments, the stabilizing agent is a polyoxyethylene sobitan fatty acid ester, for example polysorbate 20, polysorbate 21, polysorbate 40, polysorbate 60, polysorbate 61, polysorbate 65, polysorbate 80, polysorbate 81, polysorbate 85 or polysorbate 120. In some embodiments, the stabilizing agent is polysorbate 20. In some embodiments, the stabilizing agent is polysorbate 21. In some embodiments, the stabilizing agent is polysorbate 40. In some embodiments, the stabilizing agent is polysorbate 60. In some embodiments, the stabilizing agent is polysorbate 61. In some embodiments, the stabilizing agent is polysorbate 65. In some embodiments, the stabilizing agent is polysorbate 80. In some embodiments, the stabilizing agent is polysorbate 81. In some embodiments, the stabilizing agent is polysorbate 85. In some embodiments, the stabilizing agent is polysorbate 120.

Preservatives-Antioxidants, Antimicrobial and Chelating Agents

The aqueous pharmaceutical formulations disclosed herein can comprise one or more antioxidants in order to prevent/minimize the oxidation of the peptidomimetic macrocycle and/or the excipients present in the formulation The antioxidants can also be used as a stabilizing agent. The anti-oxidants which can be used to form aqueous pharmaceutical formulations the disclosure include, but are not limited to, propyl, octyl and dodecyl esters of gallic acid, butylated hydroxyanisole (BHA, usually purchased as a mixture of ortho and meta isomers), green tea extract, uric acid, cysteine, pyruvate, nordihydroguaiaretic acid, ascorbic acid, salts of ascorbic acid such as ascorbyl palmitate and sodium ascorbate, ascorbyl glucosamine, vitamin E (i.e., tocopherols such as α-tocopherol), derivatives of vitamin E (e.g., tocopheryl acetate), retinoids such as retinoic acid, retinol, trans-retinol, cis-retinol, mixtures of trans-retinol and cis-retinol, 3-dehydroretinol and derivatives of vitamin A (e.g., retinyl acetate, retinal and retinyl palmitate, also known as tetinyl palmitate), sodium citrate, sodium sulfite, sodium thiosulfate, sodium bisulfate, lycopene, anthocyanids, bioflavinoids (e.g., hesperitin, naringen, rutin and quercetin), superoxide dismutase, glutathione peroxidase, butylated hydroxytoluene (BHT), indole-3-carbinol, pycnogenol, melatonin, sulforaphane, pregnenolone, lipoic acid and 4-hydroxy-5-methyl-3[2H]-furanone. In various embodiments, one or more of the above antioxidants are excluded, or are present in less than effective amounts.

In some embodiments the antioxidant is ascorbic acid, citric acid, acetylcysteine, sulfurous acid salts (such as bisulfite, metasulfite), and monothioglyercol.

The aqueous pharmaceutical formulations can comprise one or more antimicrobial agent. Suitable antimicrobial agents that can be used include alcohol, benzalkonium chloride, benzyl alcohol, boric acid, bronopol, butylated hydroxyanisole, butylparaben, carbon dioxide, bentonite, cetrimide, cetylpyridinium chloride, chlorbutanol, chlorhexidine, chlorobutanol, chlorocresol, chloroxylenol, cresol (meta cresol), dimethyl ether, ethylparaben, glycerin, hexetidine, imidurea, inactivation by magnesium trisilicate, isopropyl alcohol, lactic acid, methylparaben, monothioglycerol, parabens (methyl, propyl, butyl), phenol, phenoxyethanol, phenylethyl alcohol, phenylmercuric salts (acetate, borate, nitrate) phenylmercuric borate, phenylmercuric nitrate, potassium benzoate, potassium metabisulfite, potassium sorbate, propionic acid, propyl gallate, propylene glycol, propylparaben, sodium acetate, sodium benzoate, sodium borate, sodium lactate, sodium metabisulfite, sodium propionate, sodium sulfite, sorbic acid, synergists, edetic acid, thimerosal, xylitol, or other agents known to those skilled in the art. In some embodiments, the antimicrobial agent used is methyl paraben, ethyl paraben, propyl paraben, or a combination thereof. In some embodiments, the antimicrobial agent used is benzalkonium chloride.

The aqueous pharmaceutical formulations disclosed herein can comprise one or more chelating agents. Non-limiting examples of chelating agents which can be used to form aqueous pharmaceutical formulations of the disclosure include, but are not limited to, ethylene diaminetetraacetic acid (EDTA), EDTA disodium, calcium disodium edetate, EDTA trisodium, albumin, transferrin, desferoxamine, desferal, desferoxamine mesylate, EDTA tetrasodium and EDTA dipotassium, sodium metasilicate, citric acid monohydrate, fumaric acid, malic acid, maltol, or combinations of any of these. In some embodiments, the formulations of the current disclosure contain no or essentially no chelating agents. In some further embodiments, the formulations are solutions containing no chelating agents.

In some embodiments, the aqueous pharmaceutical formulations of the disclosure comprise no or essentially no preservatives. In some further embodiments, the aqueous pharmaceutical formulations are solutions containing no preservatives.

Surfactants

The solubility of the components of the present formulations can be enhanced by a surfactant or other appropriate co-solvent in the composition. Such co-solvents include polysorbate 20, 60, and 80, Pluronic® F68, F-84 and P-103, cyclodextrin, or other agents known to those skilled in the art. Such co-solvents can be employed at a level of from about 0.01% to 2% by weight. In addition, the surfactant can be used to prevent aggregation of the compound.

Surfactants which can be used to form aqueous pharmaceutical formulations include, but are not limited to, hydrophilic surfactants, lipophilic surfactants, and mixtures thereof. That is, a mixture of hydrophilic surfactants can be employed, a mixture of lipophilic surfactants can be employed, or a mixture of at least one hydrophilic surfactant and at least one lipophilic surfactant can be employed.

In some embodiments of the disclosure, the surfactant can be the sodium salt form of the compound, which can include the monosodium salt form. Suitable sodium salt surfactants can be selected based on desirable properties, including high speed of polymerization, small resultant particle sizes suitable for delivery, good polymerization yields, stability including freeze-thaw and shelf-life stability, improved surface tension properties, and lubrication properties.

The surfactant can be any suitable, non-toxic compound that is non-reactive with the medicament and that substantially reduces the surface tension between the medicament, the excipient and the site of administration. Some useful surfactants are: oleic acid available under the trade names Mednique 6322 and Emersol 6321 (from Cognis Corp., Cincinnati, Ohio); cetylpyridinium chloride (from Arrow Chemical, Inc. Westwood, N.J.); soya lecithin available under the trade name Epikuron 200 (from Lucas Meyer Decatur, Ill.); polyoxyethylene(20) sorbitan monolaurate available under the tradename Tween 20 (from ICI Specialty Chemicals, Wilmington, Del.); polyoxyethylene(20) sorbitan monostearate available under the tradename Tween 60 (from ICI); polyoxyethylene(20) sorbitan monooleate available under the tradename Tween 80 (from ICI); polyoxyethylene (10) stearyl ether available under the tradename Brij 76 (from ICI); polyoxyethylene (2) oleyl ether available under the tradename Brij 92 (frown ICI); Polyoxyethylene-polyoxypropylene-ethylenediamine block copolymer available under the tradename Tetronic 150 $R_1$ (from BASF); polyoxypropylene-polyoxyethylene block copolymers available under the trade names Pluronic L-92, Pluronic L-121 end Pluronic F 68 (from BASF); castor oil ethoxylate available under the tradename Alkasurf CO-40 (from Rhone-Poulenc Mississauga Ontario, Canada); and mixtures thereof.

A suitable hydrophilic surfactant can generally have an HLB value of at least 10, while suitable lipophilic surfactants can generally have an HLB value of or less than about 10. An empirical parameter used to characterize the relative hydrophilicity and hydrophobicity of non-ionic amphiphilic compounds is the hydrophilic-lipophilic balance ("HLB" value). Surfactants with lower HLB values are more lipophilic or hydrophobic, and have greater solubility in oils, while surfactants with higher HLB values are more hydrophilic, and have greater solubility in aqueous solutions. Hydrophilic surfactants are generally considered to be those compounds having an HLB value greater than about 10, as well as anionic, cationic, or zwitterionic compounds for which the HLB scale is not generally applicable. Similarly, lipophilic (i.e., hydrophobic) surfactants are compounds having an HLB value equal to or less than about 10. However, HLB value of a surfactant is merely a rough guide generally used to enable formulation of industrial, pharmaceutical and cosmetic emulsions.

Hydrophilic surfactants can be either ionic or non-ionic. Suitable ionic surfactants include, but are not limited to, alkylammonium salts; fusidic acid salts; fatty acid derivatives of amino acids, oligopeptides, and polypeptides; glyceride derivatives of amino acids, oligopeptides, and polypeptides; lecithins and hydrogenated lecithins; lysolecithins and hydrogenated lysolecithins; phospholipids and derivatives thereof, lysophospholipids and derivatives thereof; carnitine fatty acid ester salts; salts of alkylsulfates; fatty acid salts; sodium docusate; acyl lactylates; mono- and di-acetylated tartaric acid esters of mono- and di-glycerides; succinylated mono- and di-glycerides; citric acid esters of mono- and di-glycerides; and mixtures thereof.

Within the aforementioned group, some ionic surfactants include, by way of example: lecithins, lysolecithin, phospholipids, lysophospholipids and derivatives thereof; carnitine fatty acid ester salts; salts of alkylsulfates; fatty acid salts; sodium docusate; acyl lactylates; mono- and di-acetylated tartaric acid esters of mono- and di-glycerides; succinylated mono- and di-glycerides; citric acid esters of mono- and di-glycerides; and mixtures thereof.

Ionic surfactants can be the ionized forms of lecithin, lysolecithin, phosphatidylcholine, phosphatidylethanolamine, phosphatidylglycerol, phosphatidic acid, phosphatidylserine, lysophosphatidylcholine, lysophosphatidylethanolamine, lysophosphatidylglycerol, lysophosphatidic acid, lysophosphatidylserine, PEG-phosphatidylethanolamine, PVP-phosphatidylethanolamine, lactylic esters of fatty acids, stearoyl-2-lactylate, stearoyl lactylate, succinylated monoglycerides, mono/diacetylated tartaric acid esters of mono/diglycerides, citric acid esters of mono/diglycerides, cholylsarcosine, caproate, caprylate, caprate, laurate, myristate, palmitate, oleate, ricinoleate, linoleate, linolenate, stearate, lauryl sulfate, teracecyl sulfate, docusate, lauroyl camitines, palmitoyl camitines, myristoyl carnitines, and salts and mixtures thereof.

Hydrophilic non-ionic surfactants can include, but not limited to, alkylglucosides; alkylmaltosides; alkylthioglucosides; lauryl macrogolglycerides; polyoxyalkylene alkyl ethers such as polyethylene glycol alkyl ethers; polyoxyalkylene alkylphenols such as polyethylene glycol alkyl phenols; polyoxyalkylene alkyl phenol fatty acid esters such as polyethylene glycol fatty acids monoesters and polyethylene glycol fatty acids diesters; polyethylene glycol glycerol fatty acid esters; polyglycerol fatty acid esters; polyoxyalkylene sorbitan fatty acid esters such as polyethylene glycol sorbitan fatty acid esters; hydrophilic transesterification products of a polyol with at least one member of the group consisting of glycerides, vegetable oils, hydrogenated vegetable oils, fatty acids, and sterols; polyoxyethylene sterols, derivatives, and analogues thereof; polyoxyethylated vitamins and derivatives thereof; polyoxyethylene-polyoxypropylene block copolymers; and mixtures thereof; polyethylene glycol sorbitan fatty acid esters and hydrophilic transesterification products of a polyol with at least one member of the group consisting of triglycerides, vegetable oils, and hydrogenated vegetable oils. The polyol can be glycerol, ethylene glycol, polyethylene glycol, sorbitol, propylene glycol, pentaerythritol, or a saccharide.

Other hydrophilic-non-ionic surfactants include, without limitation, PEG-10 laurate, PEG-12 laurate, PEG-20 laurate, PEG-32 laurate, PEG-32 dilaurate, PEG-12 oleate, PEG-15 oleate, PEG-20 oleate, PEG-20 dioleate, PEG-32 oleate, PEG-200 oleate, PEG-400 oleate, PEG-15 stearate, PEG-32 distearate, PEG-40 stearate, PEG-100 stearate, PEG-20 dilaurate, PEG-25 glyceryl trioleate, PEG-32 dioleate, PEG-20 glyceryl laurate, PEG-30 glyceryl laurate, PEG-20 glyceryl stearate, PEG-20 glyceryl oleate, PEG-30 glyceryl oleate, PEG-30 glyceryl laurate, PEG-40 glyceryl laurate, PEG-40 palm kernel oil, PEG-50 hydrogenated castor oil, PEG-40 castor oil, PEG-35 castor oil, PEG-60 castor oil, PEG-40 hydrogenated castor oil, PEG-60 hydrogenated castor oil, PEG-60 corn oil, PEG-6 caprate/caprylate glycerides, PEG-8 caprate/caprylate glycerides, polyglyceryl-10 laurate, PEG-30 cholesterol, PEG-25 phyto sterol, PEG-30 soya sterol, PEG-20 trioleate, PEG-40 sorbitan oleate, PEG-80 sorbitan laurate, polysorbate 20, polysorbate 80, POE-9 lauryl ether, POE-23 lauryl ether, POE-10 oleyl ether, POE-20 oleyl ether, POE-20 stearyl ether, tocopheryl PEG-100 succinate, PEG-24 cholesterol, polyglyceryl-10 oleate, Tween 40, Tween 60, sucrose monostearate, sucrose monolaurate, sucrose monopalmitate, PEG 10-100 nonyl phenol series, PEG 15-100 octyl phenol series, and poloxamers.

Suitable lipophilic surfactants include, by way of example only: fatty alcohols; glycerol fatty acid esters; acetylated glycerol fatty acid esters; lower alcohol fatty acids esters; propylene glycol fatty acid esters; sorbitan fatty acid esters; polyethylene glycol sorbitan fatty acid esters; sterols and sterol derivatives; polyoxyethylated sterols and sterol derivatives; polyethylene glycol alkyl ethers; sugar esters; sugar ethers; lactic acid derivatives of mono- and di-glycerides; hydrophobic transesterification products of a polyol with at least one member of the group consisting of glycerides, vegetable oils, hydrogenated vegetable oils, fatty acids and sterols; oil-soluble vitamins/vitamin derivatives; and mixtures thereof. Within this group, some lipophilic surfactants include glycerol fatty acid esters, propylene glycol fatty acid esters, and mixtures thereof, or are hydrophobic transesterification products of a polyol with at least one member of the group consisting of vegetable oils, hydrogenated vegetable oils, and triglycerides.

In some embodiments the formulations of the disclosure contain no surfactants. In some embodiments, the formulations of the disclosure are intravenous formulations containing no surfactants. In some further embodiments the formulations contain substantially no surfactant, i.e. contain less than approximately 0.0001% by weight of surfactants. In some embodiments, the formulations contain essentially no surfactants.

If desired, however, the formulations can contain surface-active agents conventionally employed, such as oleic acid, lecithin, sorbitan trioleate, cetylpyridinium chloride, benzalkonium chloride, polyoxyethylene (20) sorbitan monolaurate, polyoxyethylene (20) sorbitan monostearate, polyoxyethylene (20) sorbitan mono-oleate, polyoxypropylene/polyoxyethylene block copolymers, polyoxypropylene/polyoxyethylene/ethylene diamine block copolymers, ethoxylated castor oil and the like, where the proportion of surface-active agents, if present, can be about 0.0001 to 1% by weight, or about 0.001 to 0.1% by weight, based on the total formulation. Other suitable surfactant/emulsifying agents would be known to one of skill in the art and are listed in the CTFA International Cosmetic Ingredient Dictionary and Handbook, Vol. 2, 7th Edition (1997).

The aqueous pharmaceutical formulations of the disclosure can further include other pharmacological active ingredients as far as they do not contradict the purpose of the present disclosure. The aqueous pharmaceutical formulations for example can comprise solubilizing agents, bulking agents, dissolution enhancers, wetting agents, emulsifiers, suspending agents, antibacterial agents, sweeteners, perfuming agents, flavoring agents, and combinations thereof.

Some of the excipients or additives can have more than one possible function or use, depending on their properties and the nature of the formulation. In a combination of plural active ingredients, their respective contents can be suitably increased or decreased in consideration of their effects and safety.

Peptidomimetic Macrocycles

In some embodiments; a peptidomimetic macrocycle has the Formula (I):

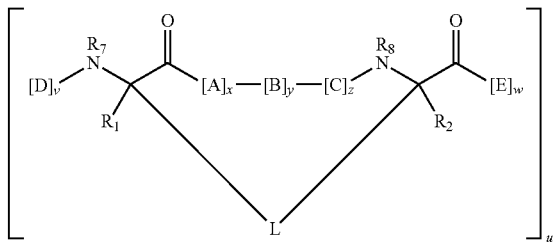

Formula I wherein:
each A, C, and D is independently an amino acid;
each B is independently an amino acid,

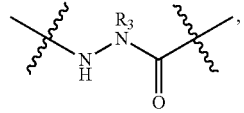

[—NH-$L_3$-CO—], [—NH-$L_3$-$SO_2$—], or [—NH-$L_3$-];
each E is independently an amino acid selected from the group consisting of Ala (alanine), D-Ala (D-alanine), Aib (α-aminoisobutyric acid), Sar (N-methyl glycine), and Ser (serine);
each $R_3$ independently is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;
each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-; or forms a macrocycle-forming linker L' connected to the alpha position of one of said D or E amino acids;

each L and L' is independently a macrocycle-forming linker;

each $L_3$ is independently alkylene, alkenylene, alkynylene, heteroalkylene, cycloalkylene, heterocycloalkylene, cycloarylene, heterocycloarylene, or $[-R_4-K-R_4-]_n$, each being optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_5$ is independently halogen, alkyl, $-OR_6$, $-N(R_6)_2$, $-SR_6$, $-SOR_6$, $-SO_2R_6$, $-CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

each V is independently an integer;
each w is independently an integer from 3-1000;
u is an integer from 1-10;
each x, y and z is independently an integer from 0-10; and
each n is independently an integer from 1-5.

In some embodiments, each v and w is independently integers between 1-30. In some embodiments, w is an integer from 3-1000, for example 3-500, 3-200, 3-100, 3-50, 3-30, 3-20, or 3-10. In some embodiments, the sum of x+y+z is 3 or 6. In some embodiments, the sum of x+y+z is 3. In other embodiments, the sum of x+y+z is 6.

In some embodiments, peptidomimetic macrocycles are also provided of the formula:

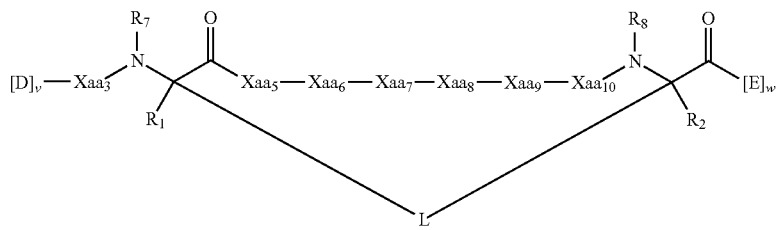

wherein:
each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 3) where each X is an amino acid;

each D and E is independently an amino acid;
each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

each L or L' is independently a macrocycle-forming linker;

each $R_5$ is independently halogen, alkyl, $-OR_6$, $-N(R_6)_2$, $-SR_6$, $-SOR_6$, $-SO_2R_6$, $-CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000, for example 1-500, 1-200, 1-100, 1-50, 1-30, 1-20 or 1-10; and w is an integer from 3-1000, for example 3-500, 3-200, 3-100, 3-50, 3-30, 3-20, or 3-10.

In some embodiments, each v and w is independently an integer between 1-30. In some embodiments, w is an integer from 3-1000, for example 3-500, 3-200, 3-100, 3-50, 3-30, 3-20, or 3-10. In some embodiments, the sum of x+y+z is 3 or 6. In some embodiments, the sum of x+y+z is 3. In other embodiments, the sum of x+y+z is 6.

In some embodiments of any of the Formulas described herein, at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 3). In other embodiments, at least four of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 3). In other embodiments, at least five of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 3). In other embodiments, at least six of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 3). In other embodiments, at least seven of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 3).

In some embodiments, a peptidomimetic macrocycle has the Formula:

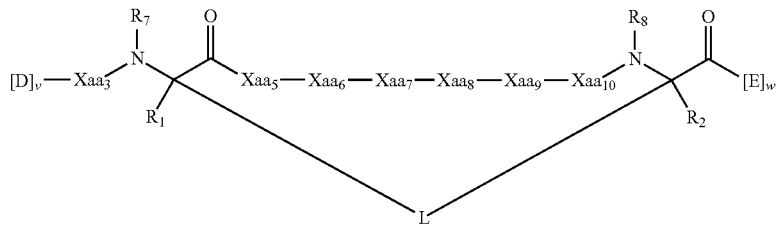

wherein:
each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_{11}$-$Ala_{12}$ (SEQ ID NO: 4), where each X is an amino acid;
each D is independently an amino acid;
each E is independently an amino acid, for example an amino acid selected from Ala (alanine), D-Ala (D-alanine), Aib (α-aminoisobutyric acid), Sar (N-methyl glycine), and Ser (serine);
each $R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;
each L or L' is independently a macrocycle-forming linker;
each $R_5$ is independently halogen, alkyl, —$OR_6$, —$N(R_6)_2$, —$SR_6$, —$SOR_B$, —$SO_2R_6$, —$CO_2R_6$, a fluorescent moiety, a radioisotope or a therapeutic agent;
each $R_6$ is independently —H, alkyl, alkenyl, alkynyl, arylalkyl, cycloalkylalkyl, heterocycloalkyl, a fluorescent moiety, a radioisotope or a therapeutic agent;
each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;
each $R_8$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;
v is an integer from 1-1000, for example 1-500, 1-200, 1-100, 1-50, 1-30, 1-20, or 1-10;
w is an integer from 3-1000, for example 3-500, 3-200, 3-100, 3-50, 3-30, 3-20, or 3-10; and.

In some embodiments of the above Formula, at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_{11}$-$Ala_{12}$ (SEQ ID NO: 4). In other embodiments of the above Formula, at least four of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_{11}$-$Ala_{12}$ (SEQ ID NO: 4). In other embodiments of the above Formula, at least five of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_{11}$-$Ala_{12}$ (SEQ ID NO: 4). In other embodiments of the above Formula, at least six of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_{11}$-$Ala_{12}$ (SEQ ID NO: 4). In other embodiments of the above Formula, at least seven of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$Glu_5$-$Tyr_6$-$Trp_7$-$Ala_8$-$Gln_9$-$Leu_{10}$/$Cba_{10}$-$X_{11}$-$Ala_{12}$ (SEQ ID NO: 4).

In some embodiments, w is an integer from 3-10, for example 3-6, 3-8, 6-8, or 6-10. In some embodiments, w is 3. In other embodiments, w is 6. In some embodiments, v is an integer from 1-10, for example 2-5. In some embodiments, v is 2.

In one embodiment, the peptidomimetic macrocycle of Formula (I) is Formula (Ia):

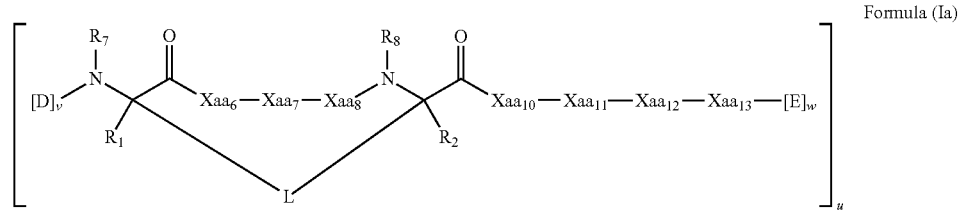

Formula (Ia)

or a pharmaceutically-acceptable salt thereof wherein:
each of $Xaa_6$, $Xaa_7$, $Xaa_8$, $Xaa_{10}$, $Xaa_{11}$, $Xaa_{12}$, and $Xaa_{13}$ is independently an amino acid, wherein at least three, four, five, or each of $Xaa_6$, $Xaa_7$, $Xaa_8$, $Xaa_{10}$, $Xaa_{11}$, $Xaa_{12}$, are the same amino acid as the amino acid at the corresponding position of the sequence $X_5$-$Thr_6$-$Leu_7$-$Leu_8$-$X_9$-$Leu_{10}$-$Lys_{11}$/$Ala_{12}$ (SEQ ID NO: 6), where each of $X_5$ and $X_9$ is independently an amino acid.

In some embodiments, the peptidomimetic macrocycle of Formula (Ia) is Formula (Ia-1):

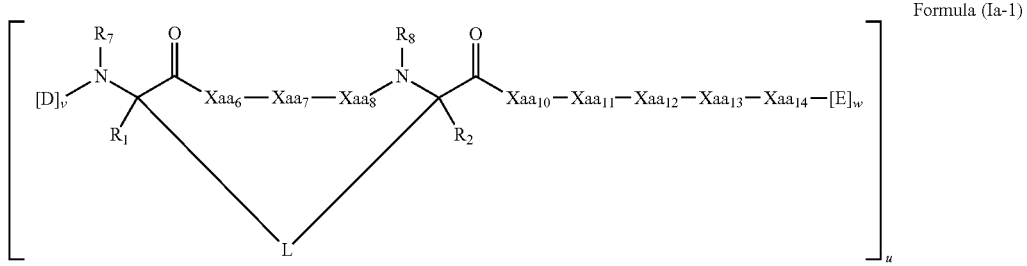

Formula (Ia-1)

or a pharmaceutically-acceptable salt thereof, wherein each $Xaa_{14}$ is independently an amino acid.

In some embodiments, the peptidomimetic macrocycle of Formula (Ia) is Formula (Ia-2):

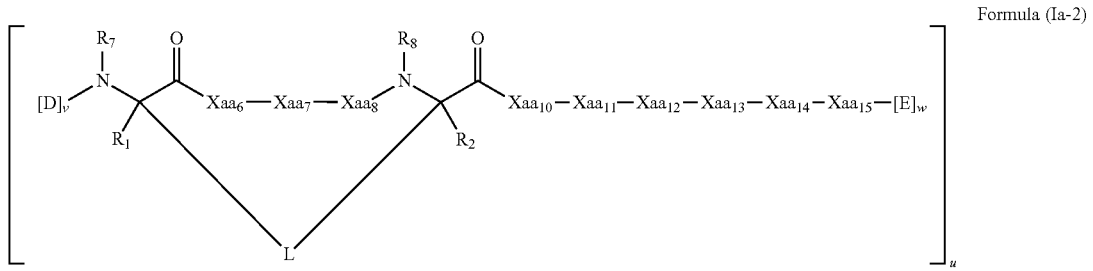

Formula (Ia-2)

or a pharmaceutically-acceptable salt thereof, wherein each $Xaa_{14}$ and $Xaa_{15}$ is independently an amino acid.

In one embodiment, the peptidomimetic macrocycle of Formula (I) is Formula (Ib):

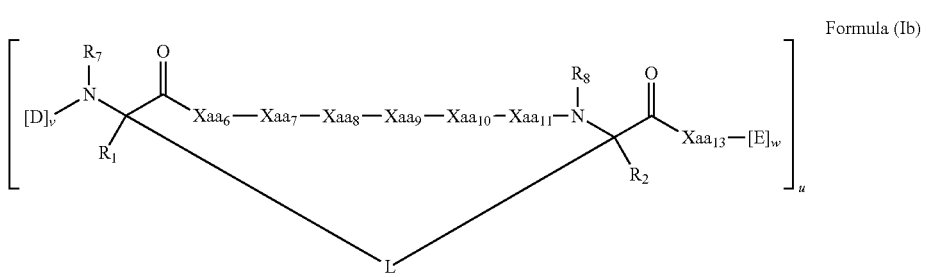

Formula (Ib)

or a pharmaceutically-acceptable salt thereof, wherein: each of $Xaa_6$, $Xaa_7$, $Xaa_8$, $Xaa_9$, $Xaa_{10}$, $Xaa_{11}$ and $Xaa_{13}$ is independently an amino acid, wherein at least three, four, five, or each of $Xaa_6$, $Xaa_7$, $Xaa_8$, $Xaa_9$, $Xaa_{10}$, and $Xaa_{11}$ are the same amino acid as the amino acid at the corresponding position of the sequence $X_5$-$Thr_6$-$Leu_7$-$Leu_8$-$Phe_9$-$Leu_{10}$-$Lys_{11}$/$Ala_{11}$-$X_{12}$ (SEQ ID NO: 7), where each of $X_5$ and $X_{12}$ is independently an amino acid.

In some embodiments, the peptidomimetic macrocycle of Formula (Ib) is Formula (Ib-1):

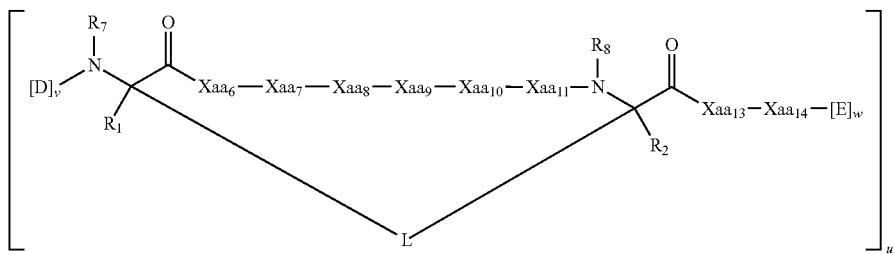

Formula (Ib-1)

or a pharmaceutically-acceptable salt thereof, wherein each $Xaa_{14}$ is independently an amino acid.

In some embodiments, the peptidomimetic macrocycle of Formula (Ib) is Formula (Ib-2):

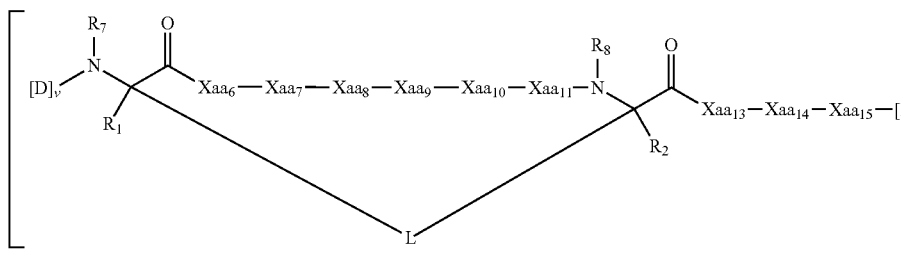

Formula (Ib-2)

or a pharmaceutically-acceptable salt thereof, wherein each $Xaa_{14}$ and $Xaa_{15}$ is independently an amino acid.

In some embodiments, the invention provides a peptidomimetic macrocycle of Formula (IX):

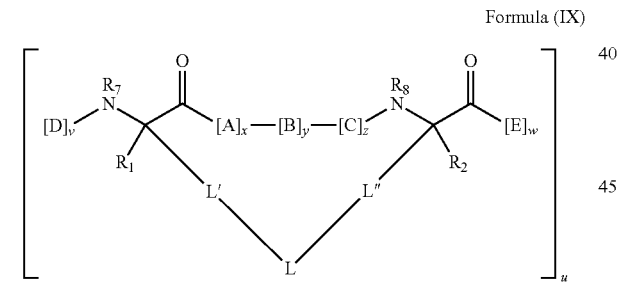

Formula (IX)

wherein the peptidomimetic macrocycle binds MCL-1 selectively over another protein that has a BH3 domain, wherein:
  each A, C, D, and E is independently a natural or non-natural amino acid;
  each B is independently a natural or non-natural amino acid, amino acid analog,

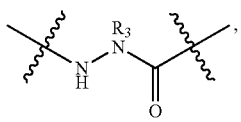

[—NH-$L_3$-CO—], [—NH-$L_3$-$SO_2$—], or [—NH-$L_3$-];
  each L is independently a macrocycle-forming linker;
  each L' is independently alkylene, alkenylene, alkynylene, heteroalkylene, cycloalkylene, heterocycloalkylene, arylene, or heteroarylene, each being optionally substituted with $R_5$, or a bond, or together with $R_1$ and the atom to which both $R_1$ and L' are bound forms a ring;
  each L" is independently alkylene, alkenylene, alkynylene, heteroalkylene, cycloalkylene, heterocycloalkylene, arylene, or heteroarylene, each being optionally substituted with $R_5$, or a bond, or together with $R_2$ and the atom to which both $R_2$ and L" are bound forms a ring;
  each $R_1$ is independently —H, alkyl, alkenyl, alkynyl, arylalkyl, cycloalkyl, cycloalkylalkyl, heteroalkyl, or heterocycloalkyl, unsubstituted or substituted with halo-, or together with L' and the atom to which both $R_1$ and L' are bound forms a ring;
  each $R_2$ is independently —H, alkyl, alkenyl, alkynyl, arylalkyl, cycloalkyl, cycloalkylalkyl, heteroalkyl, or heterocycloalkyl, unsubstituted or substituted with halo-, or together with L" and the atom to which both $R_2$ and L" are bound forms a ring;
  each $R_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with $R_5$;
  each $L_3$ is independently alkylene, alkenylene, alkynylene, heteroalkylene, cycloalkylene, heterocycloalkylene, arylene, heteroarylene, or [—$R_4$—K—$R_4$-]n, each being optionally substituted with $R_5$;
  each $R_4$ is independently alkylene, alkenylene, alkynylene, heteroalkylene, cycloalkylene, heterocycloalkylene, arylene, or heteroarylene;
  each K is independently O, S, SO, $SO_2$, CO, $CO_2$, or $CONR_3$;
  each n is independently an integer from 1-5;
  each $R_5$ is independently halogen, alkyl, —$OR_6$, —$N(R_6)_2$, —$SR_6$, —$SOR_B$, —$SO_2R_6$, —$CO_2R_6$, a fluorescent moiety, a radioisotope, or a therapeutic agent;

each $R_6$ is independently —H, alkyl, alkenyl, alkynyl, arylalkyl, cycloalkylalkyl, heterocycloalkyl, a fluorescent moiety, a radioisotope, or a therapeutic agent;

each $R_7$ is independently —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with an E residue;

each v and w is independently an integer from 1-1000;

u is an integer from 1-10; and each x, y and z is independently an integer from 0-10, or a pharmaceutically-acceptable salt thereof.

In some embodiments, the invention provides a peptidomimetic macrocycle having the formula (SEQ ID NO: 8):

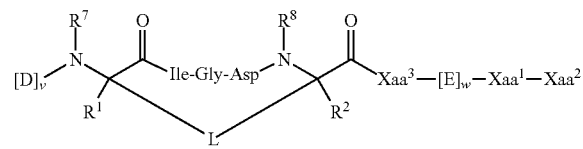

wherein:
each D and E is independently an amino acid residue;
each $R^1$ and $R^2$ are independently alkyl, alkenyl, alkynyl, arylalkyl, cycloalkyl, cycloalkylalkyl, heteroalkyl, or heterocycloalkyl, each being optionally substituted with halo-; —H, or at least one of $R^1$ and $R^2$ forms a macrocycle-forming linker L' connected to the alpha position of one of the D or E amino acid residues;
each L is a macrocycle-forming linker of the formula -L'-L²- or -L'-L²-L³-;
each $L^1$, $L^2$, and $L^3$ are independently alkylene, alkenylene, alkynylene, heteroalkylene, cycloalkylene, heterocycloalkylene, arylene, heteroarylene, or [—R⁴—K—R⁴-]$_n$, each being optionally substituted with $R^5$;
each $R^3$ is independently —H, alkyl, alkenyl, alkynyl, arylalkyl, cycloalkyl, heteroalkyl, cycloalkylalkyl, heterocycloalkyl, aryl, or heteroaryl, each being optionally substituted with $R^5$;
each $R^4$ is independently alkylene, alkenylene, alkynylene, heteroalkylene, cycloalkylene, heterocycloalkylene, arylene, or heteroarylene, each being optionally substituted with $R^5$;
each K is independently O, S, SO, $SO_2$, CO, $CO_2$, or $CONR^3$;
each $R^5$ is independently halogen, alkyl, —$OR^6$, —$N(R^6)_2$, —$SR^6$, —$SOR^6$, —$SO_2R^6$, —$CO_2R^6$, a fluorescent moiety, a radioisotope, or a therapeutic agent;

each $R^6$ is independently —H, alkyl, alkenyl, alkynyl, arylalkyl, cycloalkylalkyl, heterocycloalkyl, a fluorescent moiety, a radioisotope, or a therapeutic agent;

$R^7$ is —H, alkyl, alkenyl, alkynyl, arylalkyl, cycloalkyl, heteroalkyl, cycloalkylalkyl, heterocycloalkyl, aryl, or heteroaryl, each being optionally substituted with $R^5$, or part of a cyclic structure with a D residue;

$R^8$ is —H, alkyl, alkenyl, alkynyl, arylalkyl, cycloalkyl, heteroalkyl, cycloalkylalkyl, heterocycloalkyl, aryl, or heteroaryl, each being optionally substituted with $R^5$, or part of a cyclic structure with an E residue;

each of Xaa¹ and Xaa² is independently an amino acid residue or absent;

Xaa³ is Ala, Aib, Asp, Asn, Cys, Glu, Gln, His, Ile, Lys, Leu, Met, Arg, Ser, Thr, Val, Trp, Tyr, or an analog of any of the foregoing;

v is an integer from 1-1000;

w is an integer from 0-1000; and n is an integer from 1-5, or a pharmaceutically-acceptable salt thereof.

In some embodiments, the invention provides a peptidomimetic macrocycle of the formula:

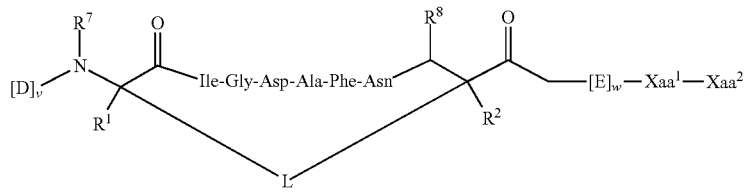

wherein:
each D and E is independently an amino acid residue;
$R^1$ and $R^2$ are independently alkyl, alkenyl, alkynyl, arylalkyl, cycloalkyl, cycloalkylalkyl, heteroalkyl, or heterocycloalkyl, each being optionally substituted with halo-; —H, or at least one of $R^1$ and $R^2$ forms a macrocycle-forming linker L' connected to the alpha position of one of the D or E amino acid residues;
each L or L' is independently a macrocycle-forming linker of the formula -L'-L²-L'-L²-L³-; L', $L^2$, and $L^3$ are independently alkylene, alkenylene, alkynylene, heteroalkylene, cycloalkylene, heterocycloalkylene, arylene, heteroarylene, or [—R⁴—K—R⁴-]$_n$, each being optionally substituted with $R^5$; each $R^3$ is independently —H, alkyl, alkenyl, alkynyl, arylalkyl, cycloalkyl, heteroalkyl, cycloalkylalkyl, heterocycloalkyl, aryl, or heteroaryl, each being optionally substituted with $R^5$;
each $R^4$ is independently alkylene, alkenylene, alkynylene, heteroalkylene, cycloalkylene, heterocycloalkylene, arylene, or heteroarylene, each being optionally substituted with $R^5$;
each K is independently O, S, SO, $SO_2$, CO, $CO_2$, or $CONR^3$;
each $R^5$ is independently halogen, alkyl, —$OR^6$, —$N(R^6)_2$, —$SR^6$, —SOW, —$SO_2R^6$, —$CO_2R^6$, a fluorescent moiety, a radioisotope, or a therapeutic agent;

each R⁶ is independently —H, alkyl, alkenyl, alkynyl, arylalkyl, cycloalkylalkyl, heterocycloalkyl, a fluorescent moiety, a radioisotope, or a therapeutic agent;

R⁷ is —H, alkyl, alkenyl, alkynyl, arylalkyl, cycloalkyl, heteroalkyl, cycloalkylalkyl, heterocycloalkyl, aryl, or heteroaryl, each being optionally substituted with R⁵, or part of a cyclic structure with a D residue;

R⁸ is —H, alkyl, alkenyl, alkynyl, arylalkyl, cycloalkyl, heteroalkyl, cycloalkylalkyl, heterocycloalkyl, aryl, or heteroaryl, each being optionally substituted with R⁵, or part of a cyclic structure with an E residue;

each of Xaa¹ and Xaa² is independently an amino acid residue or absent;

v is an integer from 1-1000;

w is an integer from 0-1000; and n is an integer from 1-5, or a pharmaceutically-acceptable salt thereof.

In some embodiments, the invention provides a peptidomimetic macrocycle comprising an amino acid sequence of formula:

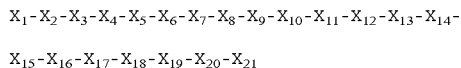

wherein:

$X_1$ is Ile, Arg, Ala, Lys, Pro, Leu, Asp, Glu, His, Ser, Gln, Phe, an analog thereof, or absent;

$X_2$ is Trp, Arg, Ala, Asn, Phe, Pro, Leu, Ser, Lys, Tyr, His, Cou, Cou2, Cou4, Cou7, an analog thereof, a crosslinked amino acid, or absent;

X3 is He, Ala, Leu, Phe, Tyr, Val, Asp, Trp, Pro, Gln, Chg, Ac5c, Ac6c, Tba, Bip, Cha, Adm, hCha, an analog thereof, or absent;

$X_4$ is Ala, Gln, Asp, Val, Gly, Ser, Leu, Phe, Cha, A4, an analog, thereof, a crosslinked amino acid, or absent;

$X_5$ is Gln, Ala, Leu, Phe, Tyr, Gly, Ile, Val, Arg, Glu, Pro, Asp, MO, MO2, an analog thereof, a crosslinked amino acid, or absent;

$X_6$ is Glu, Gln, His, Ala, Ser, Arg, Ile, Leu, Thr, Phe, Val, Tyr, Gly, Nle, St, an analog thereof, or absent;

$X_7$ is Ala, Leu, Phe, Ile, 2Nal, 1Nal, 3cf, Chg, Cha, Adm, hCha, Igl, Bip, an analog thereof, or absent;

$X_8$ is Arg, Ala, Asp, Glu, Thr, His, Gln, Gly, Asn, Phe, Cit, St, an analog thereof, a crosslinked amino acid, or absent;

$X_9$ is Arg, Ala, Asp, Lys, Asn, Gly, Ser, Gln, Cys, Nle, St, an analog thereof, or a crosslinked amino acid;

$X_{10}$ is Ile, Val, Ala, Asp, Asn, Phe, Tba, hL, hhL, Nle, Chg, Cha, an analog thereof, or a crosslinked amino acid;

$X_{11}$ is Gly, Val, Ala, Leu, Ile, Asp, Glu, Cha, Aib, Abu, an analog thereof, or a crosslinked amino acid;

$X_{12}$ is Asp, Ala, Asn, Gly, Arg, Glu, Lys, Leu, Nle, an analog thereof, or a crosslinked amino acid;

$X_{13}$ is Ala, Glu, Gln, Leu, Lys, Asp, Tyr, Ile, Ser, Cys, St, Sta5, Aib, Nle, an analog thereof, or a crosslinked amino acid;

$X_{14}$ is Phe, Ala, Leu, Val, Tyr, Glu, His, Ile, Nle, 1Nal, 2Nal, Chg, Cha, BiP, an analog thereof, or a crosslinked amino acid;

$X_{15}$ is Asn, Gln, Ser, His, Glu, Asp, Ala, Leu, Ile, St, Nle, Aib, an analog thereof, a crosslinked amino acid, or absent;

$X_{16}$ is Ala, Glu, Asp, Arg, Lys, Phe, Gly, Gln, Aib, Cha, St, an analog thereof, a crosslinked amino acid, or absent;

$X_{17}$ is Phe, Tyr, Ala, Leu, Asn, Ser, Gln, Arg, His, Thr, Cou2, Cou3, Cou7, Dpr, Amf, Damf, Amye, an analog thereof, a crosslinked amino acid, or absent;

$X_{18}$ is Tyr, Ala, Ile, Phe, His, Arg, Lys, Trp, Orn, Amf, Amye, Cha, 2Nal, an analog thereof, or absent;

$X_{19}$ is Ala, Lys, Arg, His, Ser, Gln, Glu, Asp, Thr, Aib, Cha, an analog thereof, a crosslinked amino acid, or absent; and $X_{20}$ is Arg, His, Ala, Thr, Lys, Amr, an analog thereof, a crosslinked amino acid, or absent; and $X_{21}$ is Arg, His, Ala, Amr, an analog thereof, or absent, or a pharmaceutically-acceptable salt thereof, wherein at least two of the amino acids of the amino acid sequence are a crosslinked amino acid.

In some embodiments, the invention provides a peptidomimetic macrocycle comprising an amino acid sequence with C-terminal amino acid residues that are -His-His, wherein the peptidomimetic macrocycle comprises a crosslink connecting at least two amino acid residues, or a pharmaceutically-acceptable salt thereof. In an embodiment of any of the Formulas described herein, of the macrocycle-forming linker (L or L') has a formula -$L_1$-$L_2$-, wherein $L_1$ and $L_2$ are independently alkylene, alkenylene, alkynylene, heteroalkylene, cycloalkylene, heterocycloalkylene, cycloarylene, heterocycloarylene, or [—$R_4$—K—$R_4$—]$_n$, each being optionally substituted with $R_5$;

each $R_4$ is independently alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_3$ independently is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$; and n is an integer from 1-5.

In some embodiments, L (or L') is a macrocycle-forming linker of the formula

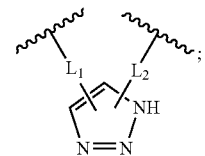

Exemplary embodiments of such macrocycle-forming linkers L are shown below.

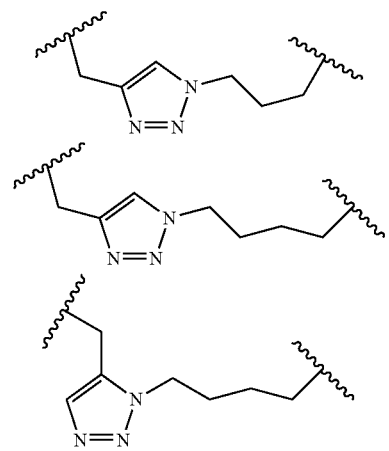

61
-continued
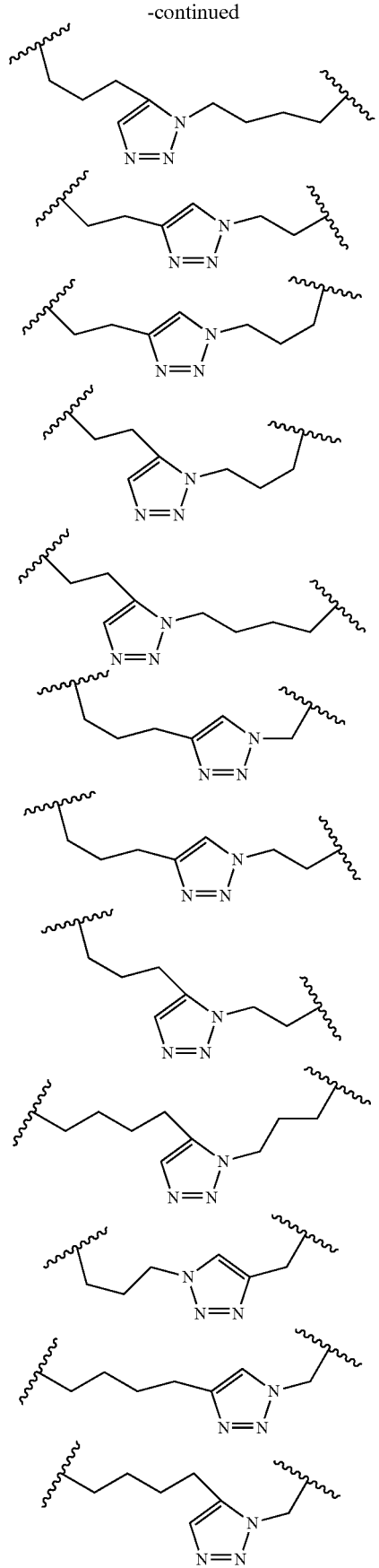
62
-continued
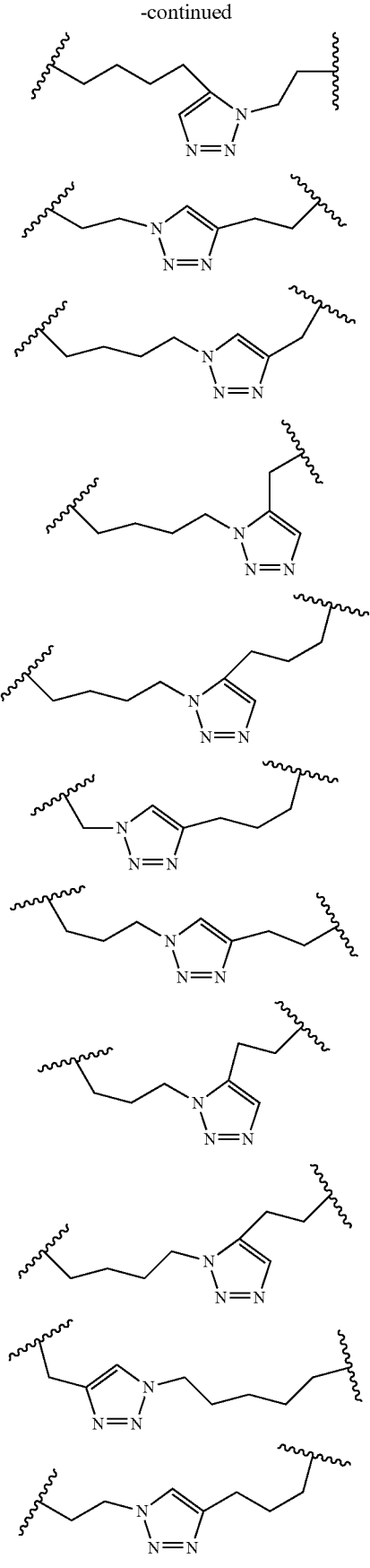

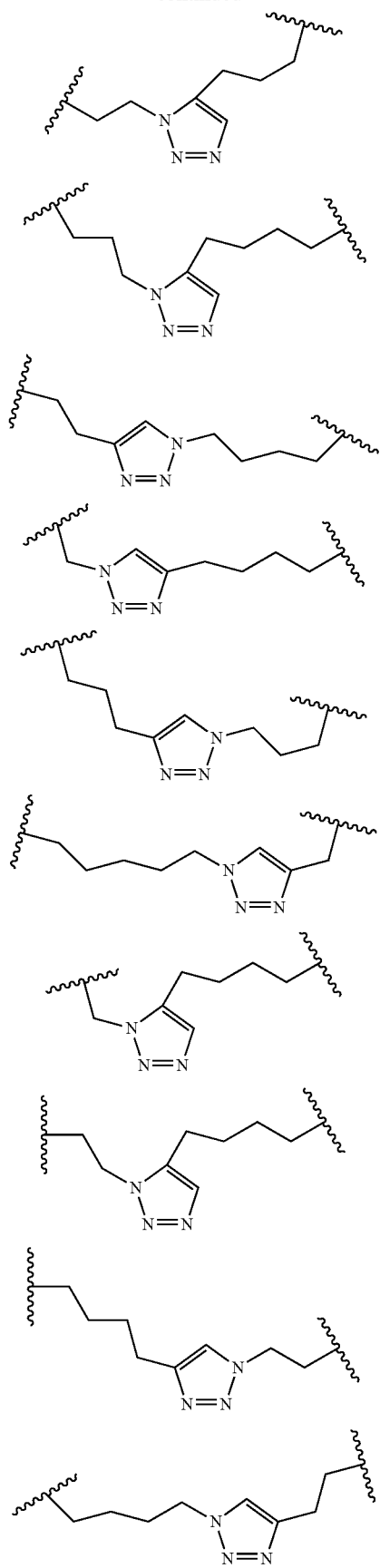
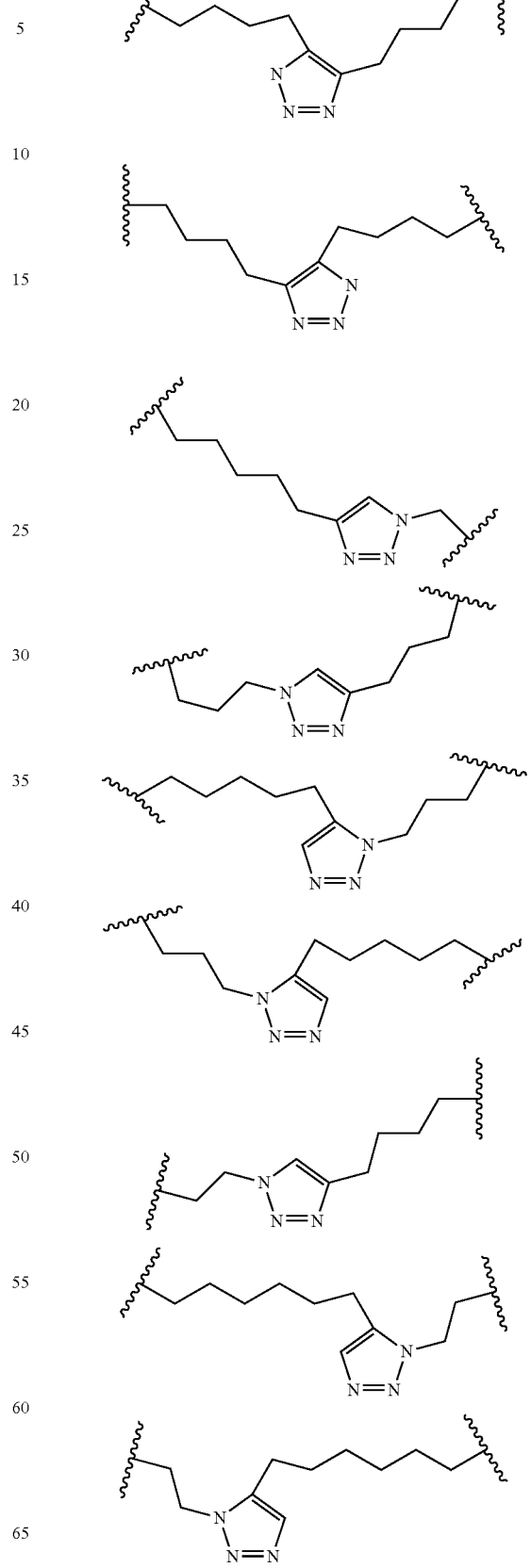

65
-continued
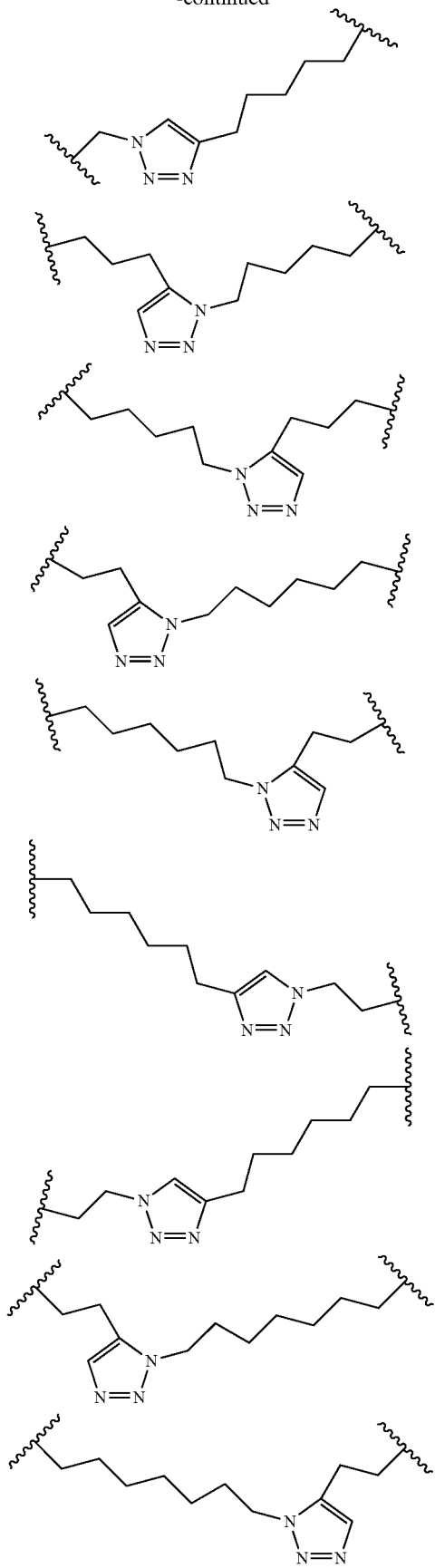
66
-continued
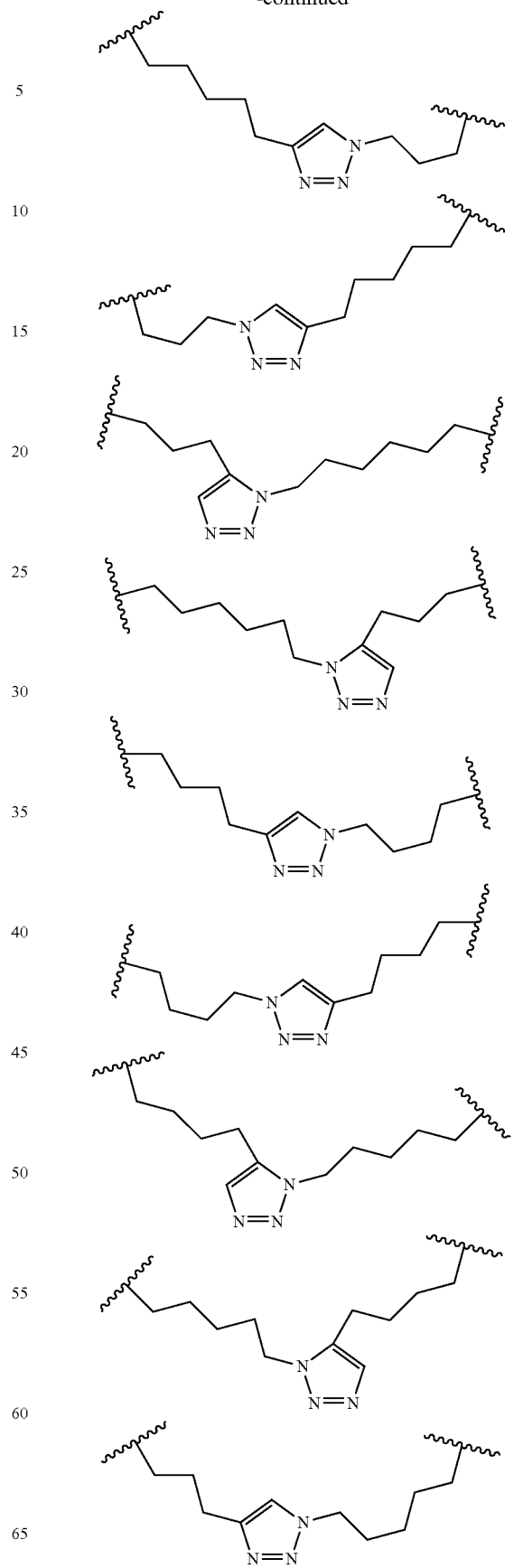

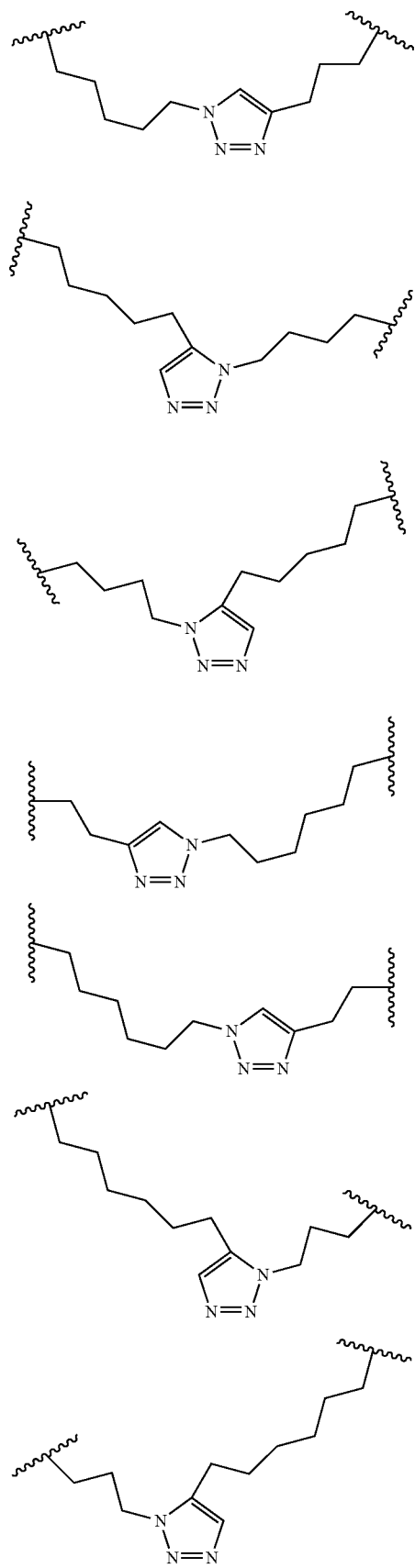
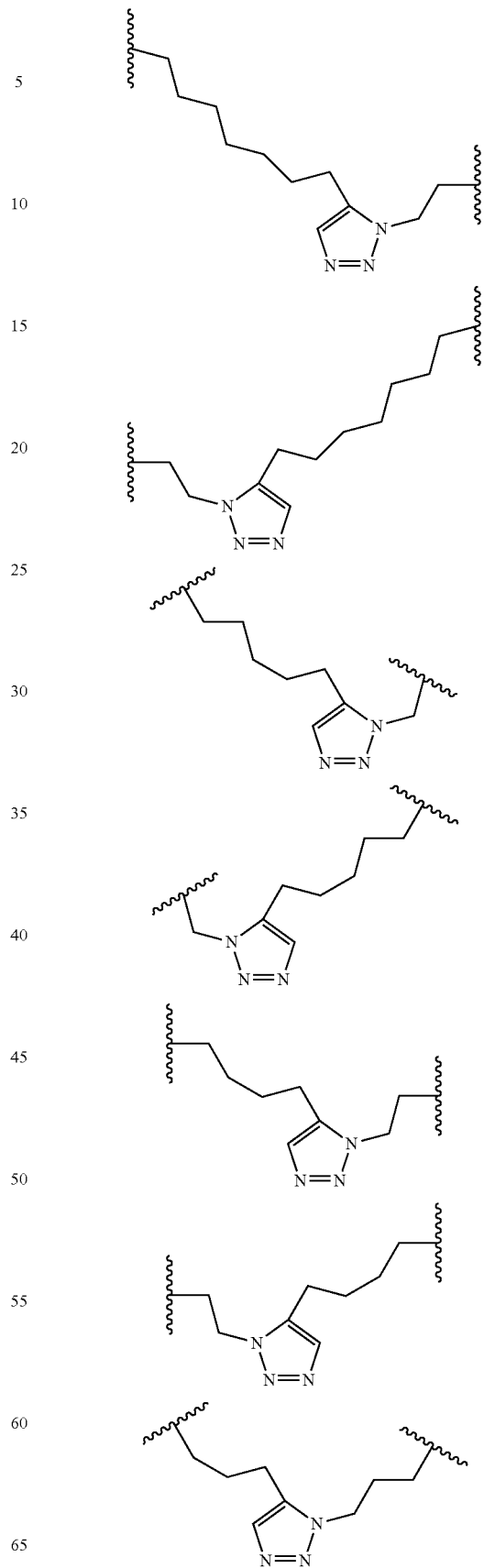

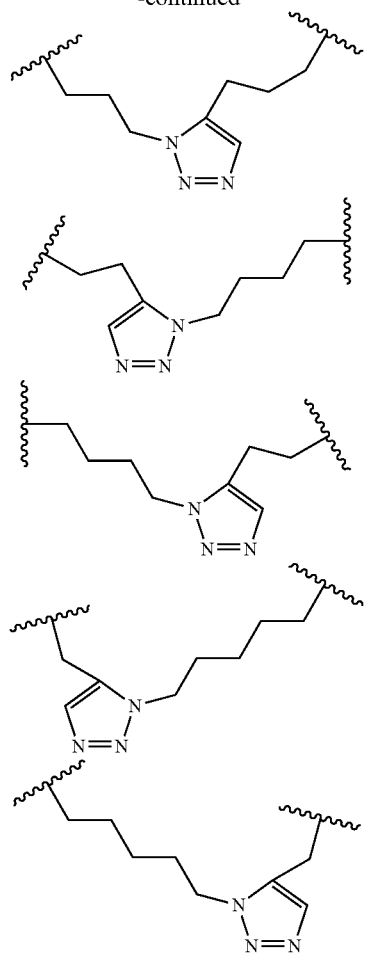

In an embodiment of any of the Formulas described herein, $L_1$ and $L_2$, either alone or in combination, form a triazole or a thioether.

In an embodiment of any of the Formulas described herein, $L_1$ and $L_2$, either alone or in combination, do not form a triazole or a thioether.

In one example, at least one of $R_1$ and $R_2$ is alkyl, unsubstituted or substituted with halo-. In another example, both $R_1$ and $R_2$ are independently alkyl, unsubstituted or substituted with halo-. In some embodiments, at least one of $R_1$ and $R_2$ is methyl. In other embodiments, $R_1$ and $R_2$ are methyl.

In some embodiments, x+y+z is at least 3. In other embodiments, x+y+z is 1, 2, 3, 4, 5, 6, 7, 8, 9 or 10. In some embodiments, the sum of x+y+z is 3 or 6. In some embodiments, the sum of x+y+z is 3. In other embodiments, the sum of x+y+z is 6. Each occurrence of A, B, C, D or E in a macrocycle or macrocycle precursor is independently selected. For example, a sequence represented by the formula $[A]_x$, when x is 3, encompasses embodiments where the amino acids are not identical, e.g. Gln-Asp-Ala as well as embodiments where the amino acids are identical, e.g. Gln-Gln-Gln. This applies for any value of x, y, or z in the indicated ranges. Similarly, when u is greater than 1, each compound can encompass peptidomimetic macrocycles which are the same or different. For example, a compound can comprise peptidomimetic macrocycles comprising different linker lengths or chemical compositions.

In some embodiments, the peptidomimetic macrocycle comprises a secondary structure which is an α-helix and $R_8$ is —H, allowing intrahelical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

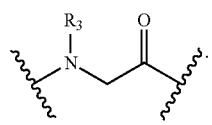

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

In some embodiments, a peptidomimetic macrocycle of Formula (I) has Formula:

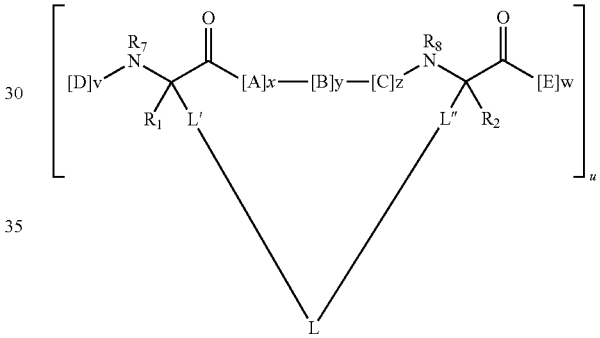

wherein:
each A, C, D, and E is independently a natural or non-natural amino acid;
each B is independently a natural or non-natural amino acid, amino acid analog

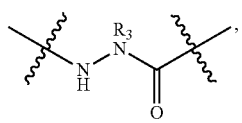

[—NH-$L_3$-CO—], [—NH-$L_3$-SO$_2$—], or [—NH-$L_3$-];
each L is independently a macrocycle-forming linker;
each L' is independently alkylene, alkenylene, alkynylene, heteroalkylene, cycloalkylene, heterocycloalkylene, arylene, or heteroarylene, each being optionally substituted with $R_5$, or a bond, or together with $R_1$ and the atom to which both $R_1$ and L' are bound forms a ring;
each L" is independently alkylene, alkenylene, alkynylene, heteroalkylene, cycloalkylene, heterocycloalkylene, arylene, or heteroarylene, each being optionally substituted with $R_5$, or a bond, or together with $R_2$ and the atom to which both $R_2$ and L" are bound forms a ring;
each $R_1$ is independently —H, alkyl, alkenyl, alkynyl, arylalkyl, cycloalkyl, cycloalkylalkyl, heteroalkyl, or heterocycloalkyl, unsubstituted or substituted with halo-, or together with L' and the atom to which both $R_1$ and L' are bound forms a ring;

each $R_2$ is independently —H, alkyl, alkenyl, alkynyl, arylalkyl, cycloalkyl, cycloalkylalkyl, heteroalkyl, or heterocycloalkyl, unsubstituted or substituted with halo-, or together with L" and the atom to which both $R_2$ and L" are bound forms a ring;

each $R_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with $R_5$;

each L3 is independently alkylene, alkenylene, alkynylene, heteroalkylene, cycloalkylene, heterocycloalkylene, arylene, heteroarylene, or $[-R_4-K-R_4-]_n$, each being optionally substituted with $R_5$;

each $R_4$ is alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each n is independently an integer from 1-5;

each $R_5$ is independently halogen, alkyl, $-OR_6$, $-N(R_6)_2$, $-SR_6$, $-SORB$, $-SO_2R_6$, $-CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with an E residue; each v and w is independently an integer from 1-1000, for example 1-500, 1-200, 1-100, 1-50, 1-40, 1-25, 1-20, 1-15, or 1-10; and each u, x, y and z is independently an integer from 0-10.

In some embodiments, the peptidomimetic macrocycles have the Formula I:

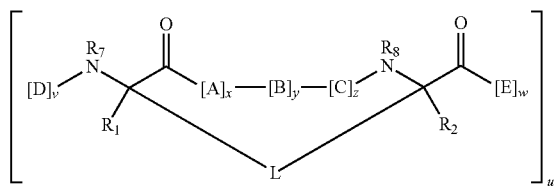

wherein:
each A, C, D, and E is independently a natural or non-natural amino acid;
each B is independently a natural or non-natural amino acid, amino acid analog,

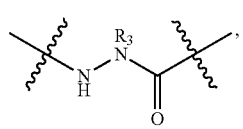

$[-NH-L_3-CO-]$, $[-NH-L_3-SO_2-]$, or $[-NH-L_3-]$;

each $R_1$ and $R_2$ is independently —H, alkyl, alkenyl, alkynyl, arylalkyl, cycloalkyl, cycloalkylalkyl, heteroalkyl, or heterocycloalkyl, unsubstituted or substituted with halo-;

each $R_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with $R_5$;

each L is independently a macrocycle-forming linker of the formula

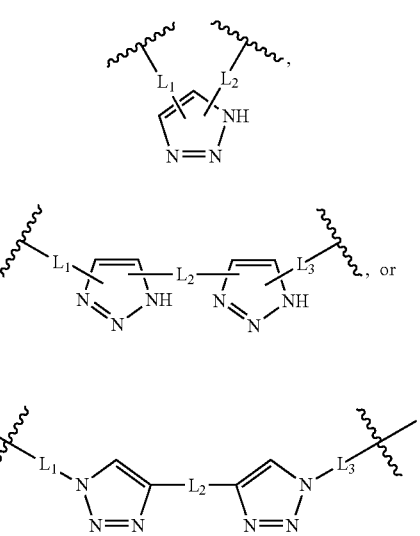

each $L_1$, $L_2$ and $L_3$ is independently alkylene, alkenylene, alkynylene, heteroalkylene, cycloalkylene, heterocycloalkylene, arylene, heteroarylene, or $[-R_4-K-R_4-]_n$, each being optionally substituted with $R_5$;

each $R_4$ is alkylene, alkenylene, alkynylene, heteroalkylene, cycloalkylene, heterocycloalkylene, arylene, or heteroarylene;

each K is independently O, S, SO, $SO_2$, CO, $CO_2$, or $CONR_3$;

each $R_5$ is independently halogen, alkyl, $-OR_6$, $-N(R_6)_2$, $-SR_6$, $-SOR_E$, $-SO_2R_6$, $-CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

each $R_7$ is independently —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with a D residue;

each $R_8$ is independently —H, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with an E residue;

each v and w is independently an integer from 1-1000;

each u, x, y and z is independently integers from 0-10; and n is an integer from 1-5.

In one embodiment, the peptidomimetic macrocycle of Formula (I) is:

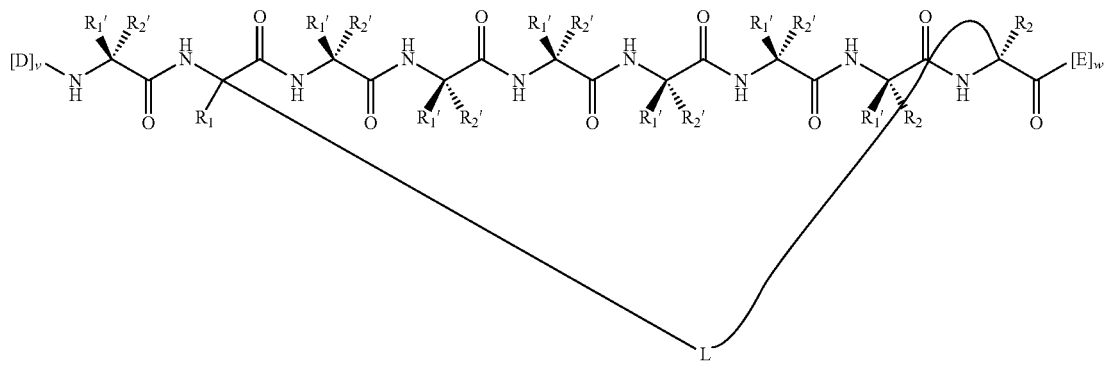

wherein each $R_1$ and $R_2$ is independently independently —H, alkyl, alkenyl, alkynyl, arylalkyl, cycloalkyl, cycloalkylalkyl, heteroalkyl, or heterocycloalkyl, unsubstituted or substituted with halo-.

In related embodiments, the peptidomimetic macrocycle of Formula (I) is:

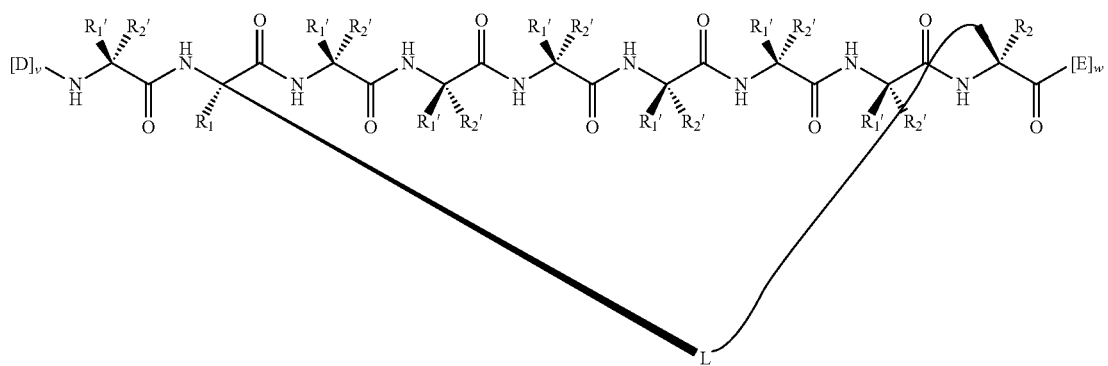

wherein each $R_1'$ and $R_2'$ is independently an amino acid.

In other embodiments, the peptidomimetic macrocycle of Formula (I) is a compound of any of the formulas shown below:

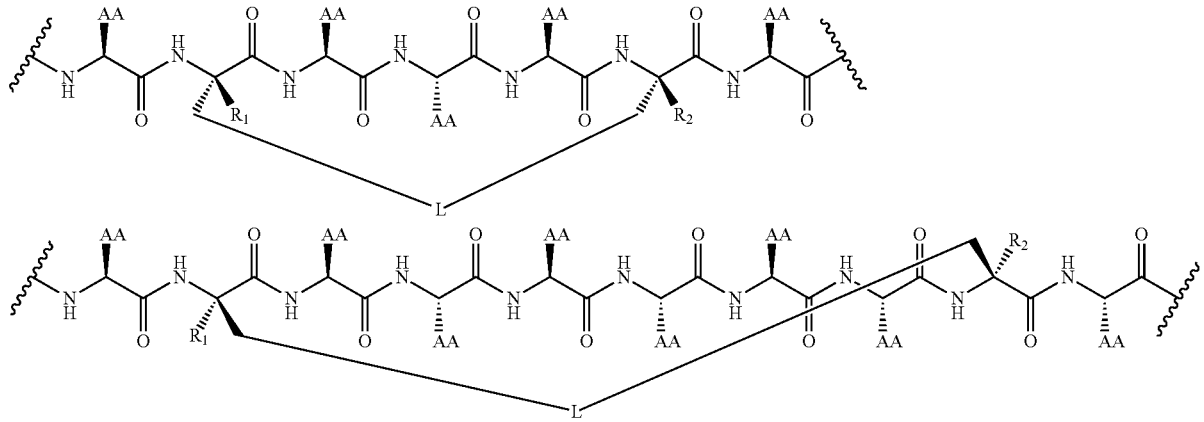

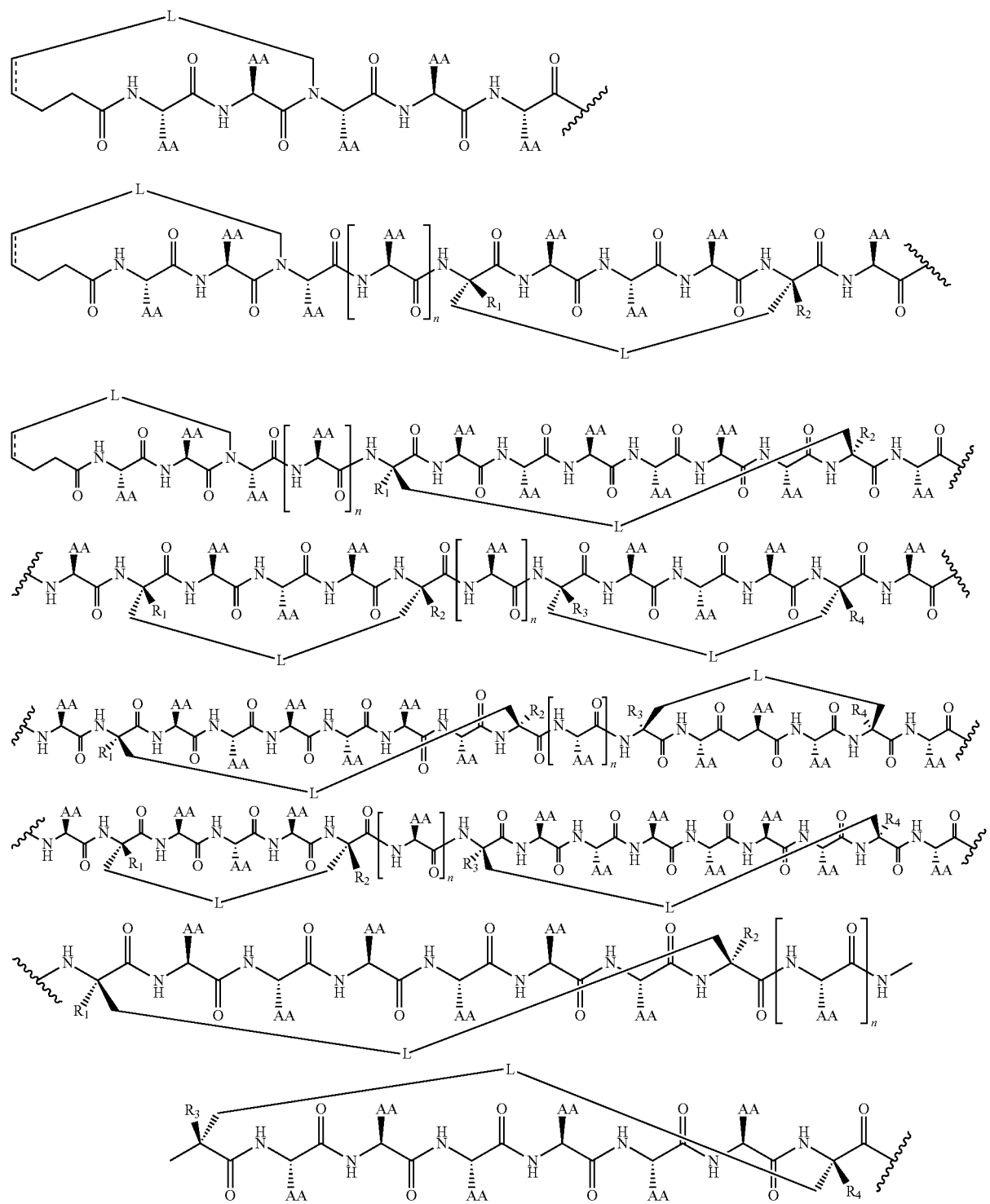
wherein "AA" represents any natural or non-natural amino acid side chain and "/" is $[D]_v$, $[E]_w$, as defined above, and n is an integer between 0 and 20, 50, 100, 200, 300, 400 or 500. In some embodiments, n is 0. In other embodiments, n is less than 50.
Exemplary embodiments of the macrocycle-forming linker L are shown below.
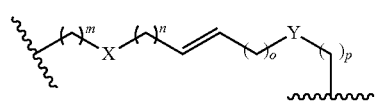
where X, Y = —$CH_2$—, O, S, or NH
m, n, o, p = 0-10

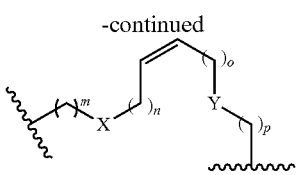

where X, Y = —CH$_2$—, O, S, or NH
m, n, o, p = 0-10

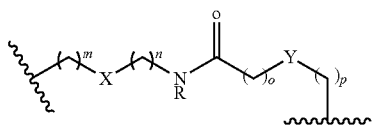

where X, Y = —CH$_2$—, O, S, or NH
m, n, o, p = 0-10
R = H, alkyl, other substituent

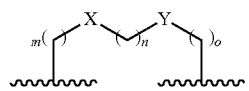

where X, Y = —CH$_2$—, O, S, or NH
m, n, o, p = 0-10

In other embodiments, D and/or E in the compound of Formula I are further modified in order to facilitate cellular uptake. In some embodiments, lipidating or PEGylating a peptidomimetic macrocycle facilitates cellular uptake, increases bioavailability, increases blood circulation, alters pharmacokinetics, decreases immunogenicity and/or decreases the needed frequency of administration.

In other embodiments, at least one of [D] and [E] in the compound of Formula I represents a moiety comprising an additional macrocycle-forming linker such that the peptidomimetic macrocycle comprises at least two macrocycle-forming linkers. In a specific embodiment, a peptidomimetic macrocycle comprises two macrocycle-forming linkers. In an embodiment, u is 2.

In some embodiments, any of the macrocycle-forming linkers described herein can be used in any combination with any of the sequences shown in Table 1, Table 1a, Table 1b, and Table 1c and also with any of the R-substituents indicated herein.

In some embodiments, the peptidomimetic macrocycle comprises at least one α-helix motif. For example, A, B and/or C in the compound of Formula I include one or more α-helices. As a general matter, α-helices include between 3 and 4 amino acid residues per turn. In some embodiments, the α-helix of the peptidomimetic macrocycle includes 1 to 5 turns and, therefore, 3 to 20 amino acid residues. In specific embodiments, the α-helix includes 1 turn, 2 turns, 3 turns, 4 turns, or 5 turns. In some embodiments, the macrocycle-forming linker stabilizes an α-helix motif included within the peptidomimetic macrocycle. Thus, in some embodiments, the length of the macrocycle-forming linker L from a first Cα to a second Cα is selected to increase the stability of an α-helix. In some embodiments, the macrocycle-forming linker spans from 1 turn to 5 turns of the α-helix. In some embodiments, the macrocycle-forming linker spans approximately 1 turn, 2 turns, 3 turns, 4 turns, or 5 turns of the α-helix. In some embodiments, the length of the macrocycle-forming linker is approximately 5 Å to 9 Å per turn of the α-helix, or approximately 6 Å to 8 Å per turn of the α-helix. Where the macrocycle-forming linker spans approximately 1 turn of an α-helix, the length is equal to approximately 5 carbon-carbon bonds to 13 carbon-carbon bonds, approximately 7 carbon-carbon bonds to 11 carbon-carbon bonds, or approximately 9 carbon-carbon bonds. Where the macrocycle-forming linker spans approximately 2 turns of an α-helix, the length is equal to approximately 8 carbon-carbon bonds to 16 carbon-carbon bonds, approximately 10 carbon-carbon bonds to 14 carbon-carbon bonds, or approximately 12 carbon-carbon bonds. Where the macrocycle-forming linker spans approximately 3 turns of an α-helix, the length is equal to approximately 14 carbon-carbon bonds to 22 carbon-carbon bonds, approximately 16 carbon-carbon bonds to 20 carbon-carbon bonds, or approximately 18 carbon-carbon bonds. Where the macrocycle-forming linker spans approximately 4 turns of an α-helix, the length is equal to approximately 20 carbon-carbon bonds to 28 carbon-carbon bonds, approximately 22 carbon-carbon bonds to 26 carbon-carbon bonds, or approximately 24 carbon-carbon bonds. Where the macrocycle-forming linker spans approximately 5 turns of an α-helix, the length is equal to approximately 26 carbon-carbon bonds to 34 carbon-carbon bonds, approximately 28 carbon-carbon bonds to 32 carbon-carbon bonds, or approximately 30 carbon-carbon bonds. Where the macrocycle-forming linker spans approximately 1 turn of an α-helix, the linkage contains approximately 4 atoms to 12 atoms, approximately 6 atoms to 10 atoms, or approximately 8 atoms. Where the macrocycle-forming linker spans approximately 2 turns of the α-helix, the linkage contains approximately 7 atoms to 15 atoms, approximately 9 atoms to 13 atoms, or approximately 11 atoms. Where the macrocycle-forming linker spans approximately 3 turns of the α-helix, the linkage contains approximately 13 atoms to 21 atoms, approximately 15 atoms to 19 atoms, or approximately 17 atoms. Where the macrocycle-forming linker spans approximately 4 turns of the α-helix, the linkage contains approximately 19 atoms to 27 atoms, approximately 21 atoms to 25 atoms, or approximately 23 atoms. Where the macrocycle-forming linker spans approximately 5 turns of the α-helix, the linkage contains approximately 25 atoms to 33 atoms, approximately 27 atoms to 31 atoms, or approximately 29 atoms. Where the macrocycle-forming linker spans approximately 1 turn of the α-helix, the resulting macrocycle forms a ring containing approximately 17 members to 25 members, approximately 19 members to 23 members, or approximately 21 members. Where the macrocycle-forming linker spans approximately 2 turns of the α-helix, the resulting macrocycle forms a ring containing approximately 29 members to 37 members, approximately 31 members to 35 members, or approximately 33 members. Where the macrocycle-forming linker spans approximately 3 turns of the α-helix, the resulting macrocycle forms a ring containing approximately 44 members to 52 members, approximately 46 members to 50 members, or approximately 48 members. Where the macrocycle-forming linker spans approximately 4 turns of the α-helix, the resulting macrocycle forms a ring containing approximately 59 members to 67 members, approximately 61 members to 65 members, or approximately 63 members. Where the macrocycle-forming linker spans approximately 5 turns of the α-helix, the resulting macrocycle forms a ring containing approximately 74 members to 82 members, approximately 76 members to 80 members, or approximately 78 members.

In other embodiments, provided are peptidomimetic macrocycles of Formula (IV) or (IVa):

Formula (IV)

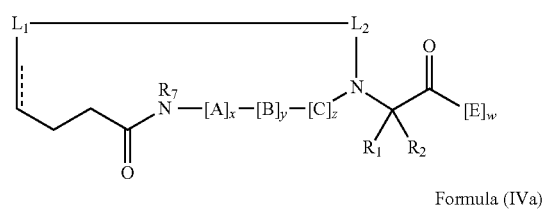

Formula (IVa)

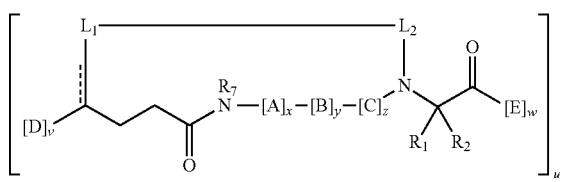

wherein:
each A, C, D, and E is independently a natural or non-natural amino acid, and the terminal D and E independently optionally include a capping group;
each B is independently a natural or non-natural amino acid, amino acid analog,

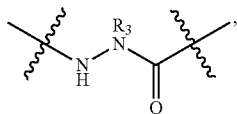

[—NH-$L_3$-CO—], [—NH-$L_3$-$SO_2$—], or [—NH-$L_3$-];
each $R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;
each $R_3$ independently is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;
each L independently is a macrocycle-forming linker of the formula -$L_1$-$L_2$-;
each $L_1$, $L_2$ and $L_3$ are independently alkylene, alkenylene, alkynylene, heteroalkylene, cycloalkylene, heterocycloalkylene, cycloarylene, heterocycloarylene, or [—$R_4$—K—$R_4$-]$_n$, each being optionally substituted with $R_5$;
each $R_4$ is independently alkylene, alkenylene, alkynylene, heteroalkylene, cycloalkylene, heterocycloalkylene, arylene, or heteroarylene;
each K is independently O, S, SO, $SO_2$, CO, $CO_2$, or $CONR_3$;
each $R_5$ is independently halogen, alkyl, —$OR_6$, —N($R_6$)$_2$, —$SR_6$, —$SOR_6$, —$SO_2R_6$, —$CO_2R_6$, a fluorescent moiety, a radioisotope or a therapeutic agent;
each $R_6$ is independently —H, alkyl, alkenyl, alkynyl, arylalkyl, cycloalkylalkyl, heterocycloalkyl, a fluorescent moiety, a radioisotope or a therapeutic agent;
each $R_7$ is independently —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$;
each v and w are independently integers from 1-1000;
u is an integer from 1-10;
each x, y and z are independently integers from 0-10; and
each n independently is an integer from 1-5.

In one example, $L_1$ and $L_2$, either alone or in combination, do not form a triazole or a thioether.

In one example, at least one of $R_1$ and $R_2$ is alkyl, unsubstituted or substituted with halo-. In another example, both $R_1$ and $R_2$ are independently alkyl, unsubstituted or substituted with halo-. In some embodiments, at least one of $R_1$ and $R_2$ is methyl. In other embodiments, $R_1$ and $R_2$ are methyl.

In some embodiments, x+y+z is at least 1. In other embodiments, x+y+z is at least 2. In other embodiments, x+y+z is 1, 2, 3, 4, 5, 6, 7, 8, 9 or 10. Each occurrence of A, B, C, D or E in a macrocycle or macrocycle precursor is independently selected. For example, a sequence represented by the formula [A]$_x$, when x is 3, encompasses embodiments where the amino acids are not identical, e.g. Gln-Asp-Ala as well as embodiments where the amino acids are identical, e.g. Gln-Gln-Gln. This applies for any value of x, y, or z in the indicated ranges.

In some embodiments, the peptidomimetic macrocycle comprises a secondary structure which is an α-helix and $R_8$ is —H, allowing intrahelical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

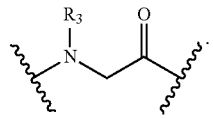

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

Exemplary embodiments of the macrocycle-forming linker -$L_1$-$L_2$- are shown below.

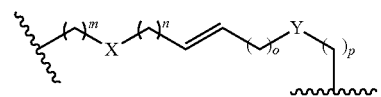

where X, Y = —$CH_2$—, O, S, or NH
m, n, o, p = 0-10

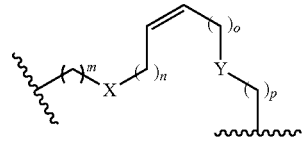

where X, Y = —$CH_2$—, O, S, or NH
m, n, o, p = 0-10

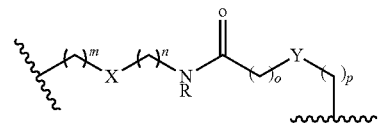

where X, Y = —$CH_2$—, O, S, or NH
m, n, o, p = 0-10
R = H, alkyl, other substituent

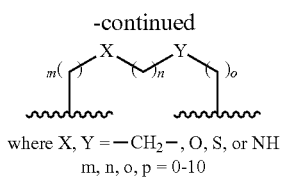
where X, Y = —CH₂—, O, S, or NH
m, n, o, p = 0-10
In some embodiments, L is a macrocycle-forming linker of the formula
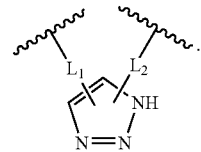
Exemplary embodiments of such macrocycle-forming linkers L are shown below.
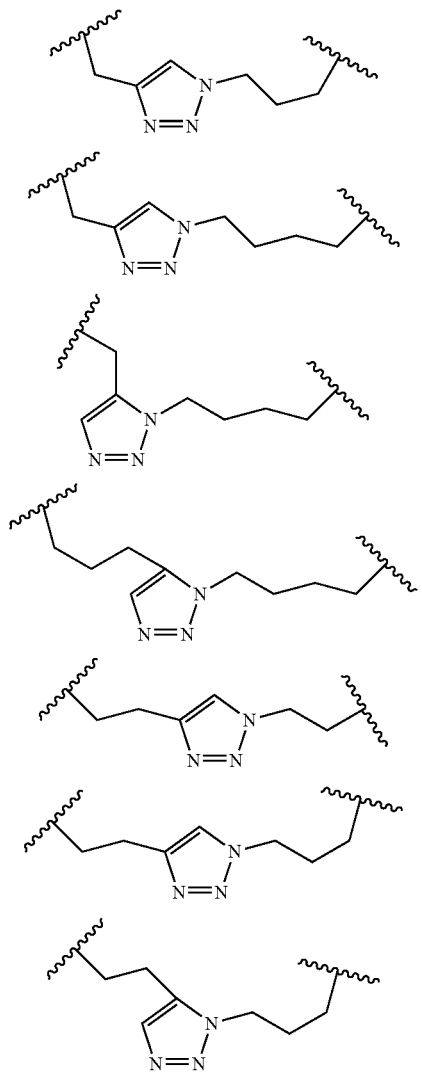
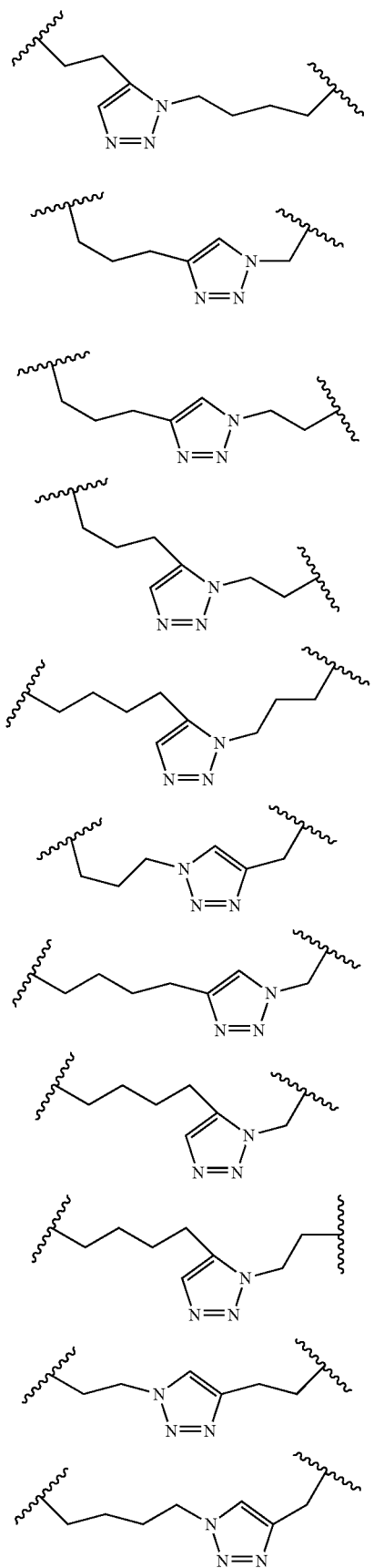

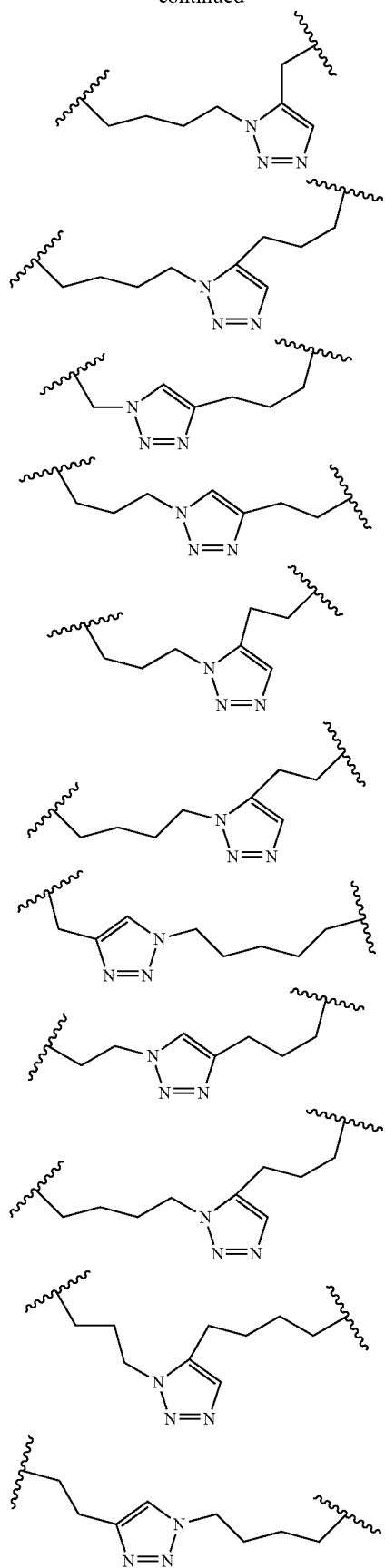
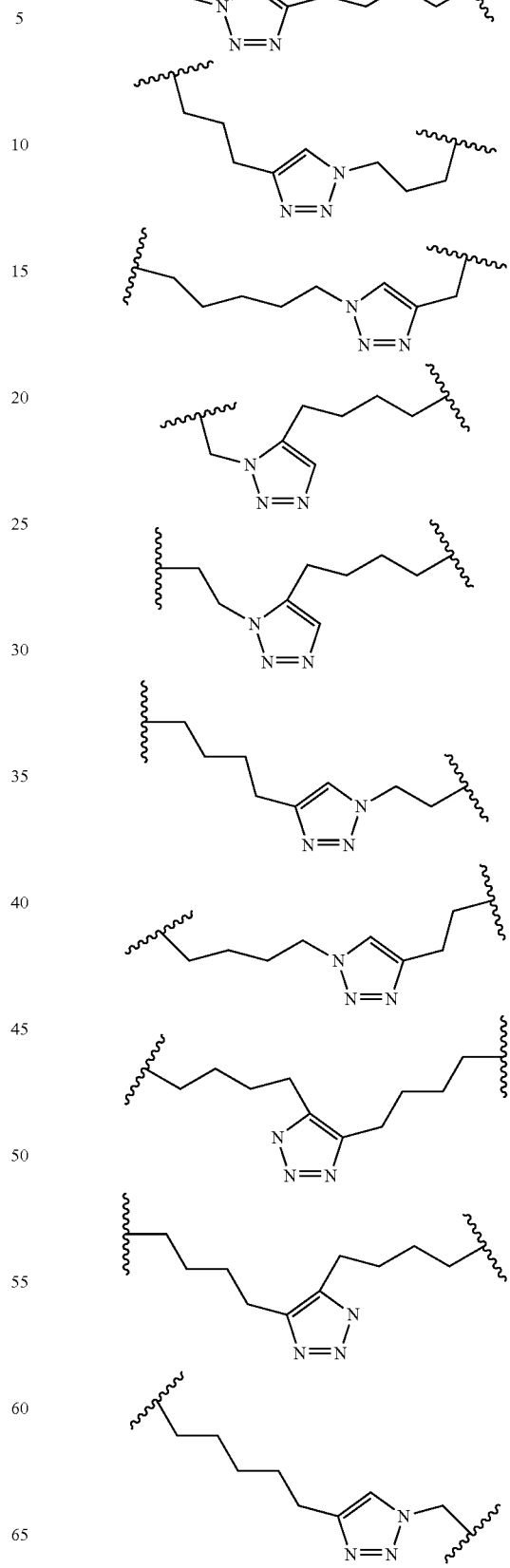

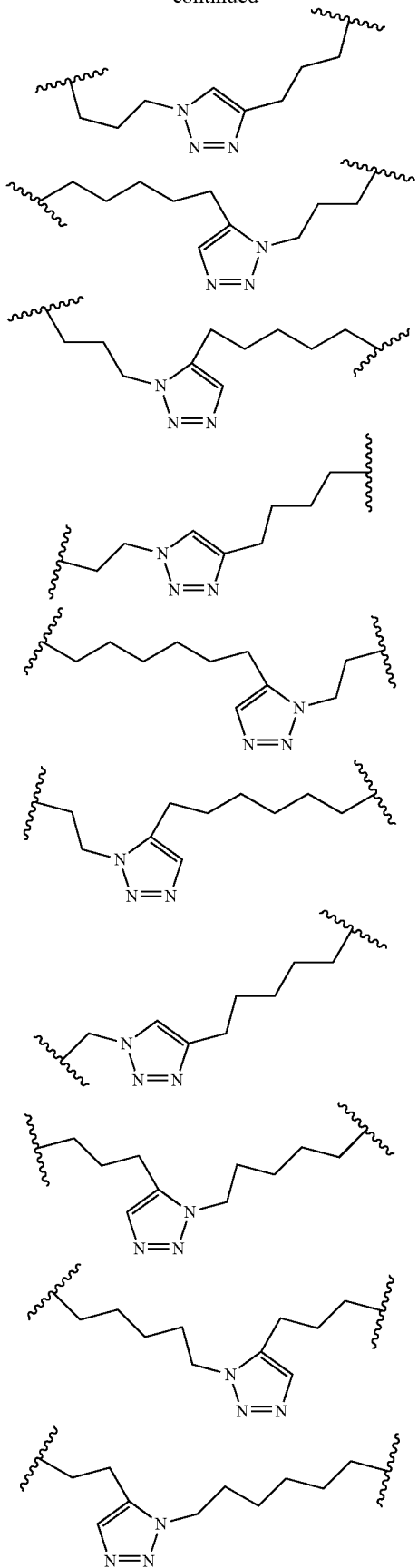
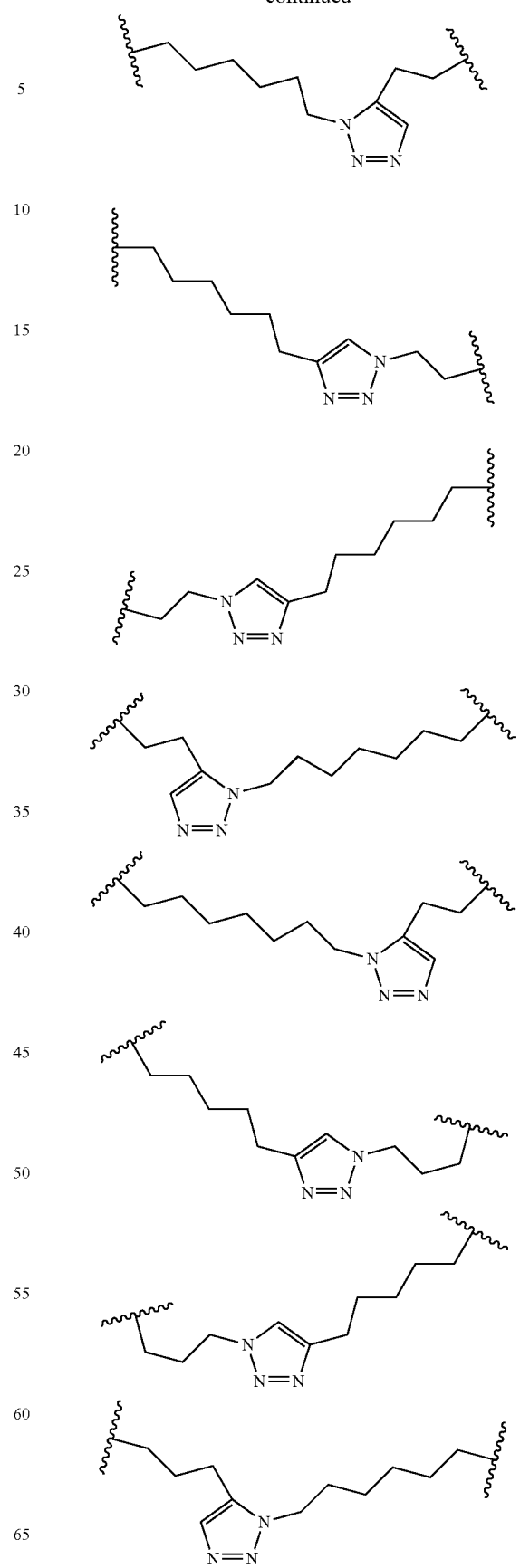

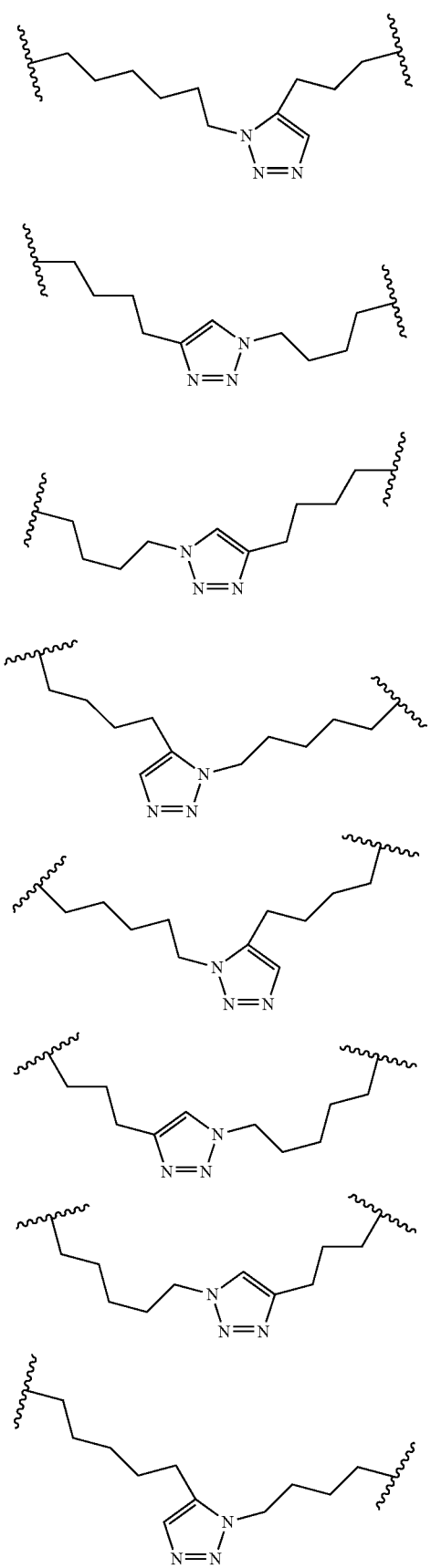
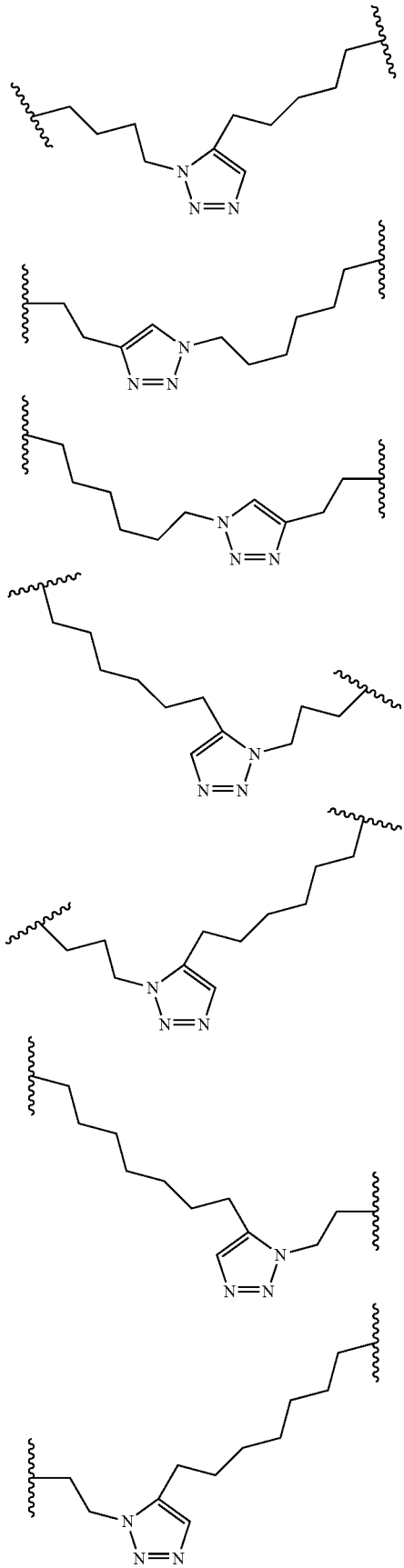

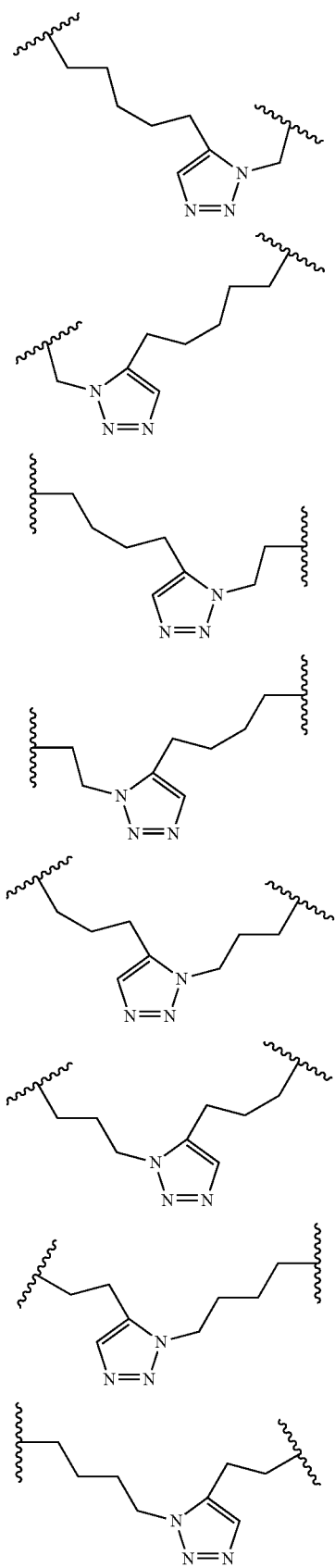

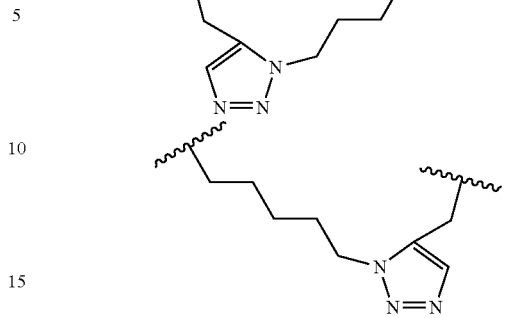

Unless otherwise stated, any compounds (including peptidomimetic macrocycles, macrocycle precursors, and other compositions) are also meant to encompass compounds which differ only in the presence of one or more isotopically enriched atoms. For example, compounds having the described structures except for the replacement of a hydrogen by a deuterium or tritium, or the replacement of a carbon by $^{13}C$- or $^{14}C$-enriched carbon are within the scope of this disclosure.

In some embodiments, the compounds disclosed herein can contain unnatural proportions of atomic isotopes at one or more of atoms that constitute such compounds. For example, the compounds can be radiolabeled with radioactive isotopes, such as for example tritium ($^{3}H$), iodine-125 ($^{125}I$) or carbon-14 ($^{14}C$). In other embodiments, one or more carbon atoms is replaced with a silicon atom. The compounds (including peptidomimetic macrocycles, macrocycle precursors, and other compositions) also include salts thereof. For example, salts of acidic and basic amino acids. All isotopic variations of the compounds disclosed herein, whether radioactive or not, are contemplated herein.

The compound or peptidomimetic macrocycles described herein can be at least 1% pure, at least 2% pure, at least 3% pure, at least 4% pure, at least 5% pure, at least 6% pure, at least 7% pure, at least 8% pure, at least 9% pure, at least 10% pure, at least 11% pure, at least 12% pure, at least 13% pure, at least 14% pure, at least 15% pure, at least 16% pure, at least 17% pure, at least 18% pure, at least 19% pure, at least 20% pure, at least 21% pure, at least 22% pure, at least 23% pure, at least 24% pure, at least 25% pure, at least 26% pure, at least 27% pure, at least 28% pure, at least 29% pure, at least 30% pure, at least 31% pure, at least 32% pure, at least 33% pure, at least 34% pure, at least 35% pure, at least 36% pure, at least 37% pure, at least 38% pure, at least 39% pure, at least 40% pure, at least 41% pure, at least 42% pure, at least 43% pure, at least 44% pure, at least 45% pure, at least 46% pure, at least 47% pure, at least 48% pure, at least 49% pure, at least 50% pure, at least 51% pure, at least 52% pure, at least 53% pure, at least 54% pure, at least 55% pure, at least 56% pure, at least 57% pure, at least 58% pure, at least 59% pure, at least 60% pure, at least 61% pure, at least 62% pure, at least 63% pure, at least 64% pure, at least 65% pure, at least 66% pure, at least 67% pure, at least 68% pure, at least 69% pure, at least 70% pure, at least 71% pure, at least 72% pure, at least 73% pure, at least 74% pure, at least 75% pure, at least 76% pure, at least 77% pure, at least 78% pure, at least 79% pure, at least 80% pure, at least 81% pure, at least 82% pure, at least 83% pure, at least 84% pure, at least 85% pure, at least 86% pure, at least 87% pure, at least 88% pure, at least 89% pure, at least 90% pure, at least 91% pure, at least 92% pure, at least 93% pure, at least 94% pure, at least 95% pure, at least 96% pure, at least 97% pure, at least 98% pure, at least 99% pure, at least 99.1% pure, at least 99.2% pure, at least 99.3% pure, at least 99.4% pure, at least 99.5% pure, at least 99.6% pure, at least 99.7% pure, at least 99.8% pure, or at least 99.9% pure on a chemical, optical, isomeric, enantiomeric, or diastereomeric basis. Purity can be assessed, for example, by HPLC, MS, LC/MS, melting point, or NMR.

Two or more peptides can share a degree of homology. A pair of peptides can have, for example, up to about 20% pairwise homology, up to about 25% pairwise homology, up to about 30% pairwise homology, up to about 35% pairwise homology, up to about 40% pairwise homology, up to about 45% pairwise homology, up to about 50% pairwise homology, up to about 55% pairwise homology, up to about 60% pairwise homology, up to about 65% pairvise homology, up to about 70% pairwise homology, up to about 75% pairwise homology, up to about 80% pairwise homology, up to about 85% pairvise homology, up to about 90% pairwise homology, up to about 95% pairwise homology, up to about 96% pairwise homology, up to about 97% pairvise homology, up to about 98% pairwise homology, up to about 99% pairwise homology, up to about 99.5% pairwise homology, or up to about 99.9% pairwise homology. A pair of peptides can have, for example, at least about 20% pairwise homology, at least about 25% pairvise homology, at least about 30% pairwise homology, at least about 35% pairwise homology, at least about 40% pairwise homology, at least about 45% pairwise homology, at least about 50% pairwise homology, at least about 55% pairwise homology, at least about 60% pairwise homology, at least about 65% pairwise homology, at least about 70% pairwise homology, at least about 75% pairwise homology, at least about 80% pairwise homology, at least about 85% pairwise homology, at least about 90% pairwise homology, at least about 95% pairwise homology, at least about 96% pairwise homology, at least about 97% pairwise homology, at least about 98% pairwise homology, at least about 99% pairwise homology, at least about 99.5% pairwise homology, at least about 99.9% pairwise homology.

Various methods and software programs can be used to determine the homology between two or more peptides, such as NCBI BLAST, Clustal W, MAFFT, Clustal Omega, AlignMe, Praline, or another suitable method or algorithm.

The circulating half-life of the peptidomimetic macrocycles in human blood can be about 1-24 h. For example the circulating half-life of the peptidomimetic macrocycles in human blood can me about 2-24 h, 4-24 h, 6-24 h, 8-24 h, 10-24 h, 12-24 h, 14-24 h, 16-24 h, 18-24 h, 20-24 h, 22-24 h, 1-20 h, 4-20 h, 6-20 h, 8-20 h, 10-20 h, 12-20 h, 14-20 h, 16-20 h, 18-20 h, 1-16 h, 4-16 h, 6-16 h, 8-16 h, 10-16 h, 12-16 h, 14-16 h, 1-12 h, 4-12 h, 6-12 h, 8-12 h, 10-12 h, 1-8 h, 4-8 h, 6-8 h, or 1-4 h. In some examples, the circulating half-life of the peptidomimetic macrocycles in human blood can be bout 1-12 h, for example about 1 h, 2 h, 3 h, 4 h, 5 h, 6 h, 7 h, 8 h, 9 h, 10 h, 11 h, or 12 h. In some examples, the circulating half-life of the peptidomimetic macrocycles in human blood is about 2 h. In some examples, the circulating half-life of the peptidomimetic macrocycles in human blood is about 4 h. In some examples, the circulating half-life of the peptidomimetic macrocycles in human blood is about 6 h. In some examples, the circulating half-life of the peptidomimetic macrocycles in human blood is about 8 h. In some examples, the circulating half-life of the peptidomimetic macrocycles in human blood is about 10 h.

The half-life of the peptidomimetic macrocycles in biological tissue can be about 1-24 h. For example the circulating half-life of the peptidomimetic macrocycles in human blood can me about 1-24 h, 5-24 h, 10-24 h, 15-24 h, 20-24 h, 1-22 h, 5-22 h, 10-22 h, 15-22 h, 20-22 h, 1-20 h, 5-20 h, 15-20 h, 1-18 h, 5-18 h, 10-18 h, 15-18 h, 1-16 h, 5-16 h, 10-16 h, 15-16 h, 1-14 h, 5-14 h, 10-14 h, 1-12 h, 5-12 h, 10-12 h, 1-10 h, 5-10 h, 1-8 h, 5-8 h, 1-6 h, 5-6 h, or 1-4 h. In some examples, the circulating half-life of the peptidomimetic macrocycles in human blood can be bout 5-20 h, for example about 5 h, 6 h, 7 h, 8 h, 9 h, 10 h, 11 h, 12 h, 13 h, 14 h, 15 h, 16 h, 17 h, 18 h, 19 h or 20 h. In some examples, the circulating half-life of the peptidomimetic macrocycles in human blood is about 2 h. In some examples, the circulating half-life of the peptidomimetic macrocycles in human blood is about 4 h. In some examples, the circulating half-life of the peptidomimetic macrocycles in human blood is about 6 h. In some examples, the circulating half-life of the peptidomimetic macrocycles in human blood is about 8 h. In some examples, the circulating half-life of the peptidomimetic macrocycles in human blood is about 10 h.

The circulating half-life of the peptidomimetic macrocycles in human blood can be greater than, equal to, or less than the half-life of the peptidomimetic macrocycles in biological tissue. In some examples, the circulating half-life of the peptidomimetic macrocycles in human blood can be greater than the half-life of the peptidomimetic macrocycles in biological tissue. In some examples, the circulating half-life of the peptidomimetic macrocycles in human blood can be equal to the half-life of the peptidomimetic macrocycles in biological tissue. In some examples, the half-life of the peptidomimetic macrocycles in biological tissue is greater than the circulating half-life of the peptidomimetic macrocycles in human blood. This can facilitate administration of the peptidomimetic macrocycles at a lower dose and/or at lower frequency. In some embodiments, the half-life of the peptidomimetic macrocycles in biological tissue is at least 1 h, 2 h, 3 h, 4 h, 5 h, 6 h, 7 h, 8 h, 9 h, 10 h, 11 h, or 12 h greater than the than the circulating half-life of the peptidomimetic macrocycles in human blood. In some examples, the circulating half-life of the peptidomimetic macrocycles in human blood is about 4 h and the half-life of the in biological tissue is about 10 h. In some examples, the circulating half-life of the peptidomimetic macrocycles in human blood is about 6 h and the half-life of the in biological tissue is about 10 h.

The cross-linked peptides of the disclosure can be modeled after the N-terminal transactivation domain of p53 ("p53 peptidomimetic macrocycles"). These cross-linked peptides contain at least two modified amino acids that together form an intramolecular cross-link that can help to stabilize the α-helical secondary structure of a portion of p53 that is thought to be important for binding of p53 to MDM2 and for binding of p53 to MDMX. Accordingly, a cross-linked polypeptide described herein can have improved biological activity relative to a corresponding polypeptide that is not cross-linked. The p53 peptidomimetic macrocycles are thought to interfere with binding of p53 to MDM2 and/or of p53 to MDMX, thereby liberating functional p53 and inhibiting its destruction. The p53 peptidomimetic macrocycles described herein can be used therapeutically, for example to treat cancers and other disorders characterized by an undesirably low level or a low activity of p53, and/or to treat cancers and other disorders characterized by an undesirably high level of activity of MDM2 or MDMX. The p53 peptidomimetic macrocycles can also be useful for treatment of any disorder associated with disrupted regulation of the p53 transcriptional pathway, leading to conditions of excess cell survival and proliferation such as cancer and autoimmunity, in addition to conditions of inappropriate cell cycle arrest and apoptosis such as neurodegeneration and immune deficiencies. In some embodiments, the p53 peptidomimetic macrocycles bind to MDM2 (e.g., GenBank® Accession No.: 228952; GI:228952) and/or MDMX (also referred to as MDM4; GenBank® Accession_No.: 88702791; GI:88702791).

Figure 3:
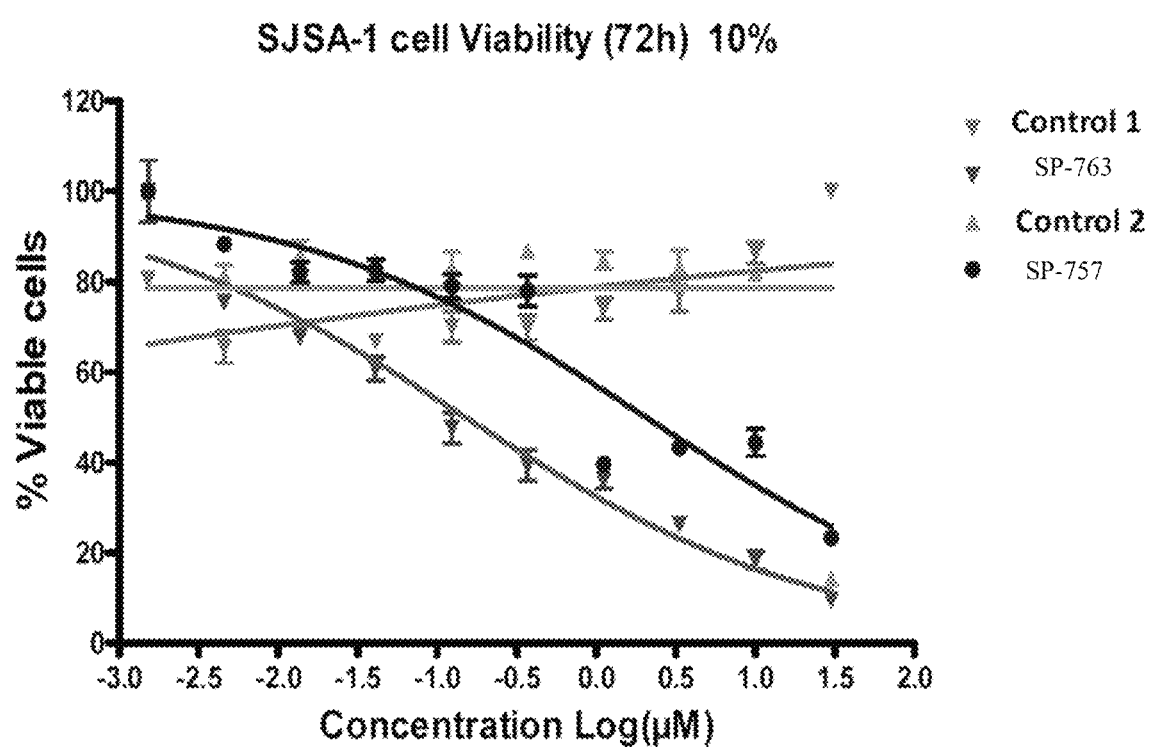
FIG. 3 Shows a plot of viable SJSA-1 cells (%) vs. log concentration (µM) of indicated peptide after incubation of the cells with the peptide for 72 hr in 10% serum.

Table 1 shows a list of peptidomimetic macrocycles derived from the MDM2/MDMX-binding helix of p53 that were prepared. Tables 1a, 1b, 1c, 1d and 1e show a list of selected peptidomimetic macrocycles from Table 1. Table if shows a list of selected peptidomimetic macrocycles from Table 1e. A partial staple scan was performed on the linear peptide p-CF$_3$-Phe7-D-PMI-β. SP-757, a potent and selective MDM2 antagonist, was prepared by including an i, i+7 crosslink to the sequence of p-CF3-Phe-7-D-PMI-b. SP-757 exhibited SJSA-1 sarcoma cell killing activity at a single digit micromolar concentration (EC$_{50}$=1.5 mM). (FIG. 3). SP-763 was prepared by increasing the alanine content to 35% while maintaining the net charge and Von Heijne score by adding four alanine residues to the C-terminus of SP-757. SP-763 exhibited improved SJSA-1 sarcoma cell killing activity (EC$_{50}$=0.15 mM) compared to SP-757 (FIG. 3). SP-763 exhibited similar cell killing activity as SP-449.

TABLE 1

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP1 | 9 Ac-F$r8AYWEAc3cL$AAA-NH2 | | 1456.78 | 729.44 | 1457.79 | 729.4 | 486.6 |
| SP2 | 10 Ac-F$r8AYWEAc3cL$AAibA-NH2 | | 1470.79 | 736.4 | 1471.8 | 736.4 | 491.27 |
| SP3 | 11 Ac-LTF$r8AYWAQL$SANle-NH2 | | 1715.97 | 859.02 | 1716.98 | 858.99 | 573 |
| SP4 | 12 Ac-LTF$r8AYWAQL$SAL-NH2 | | 1715.97 | 859.02 | 1716.98 | 858.99 | 573 |
| SP5 | 13 Ac-LTF$r8AYWAQL$SAM-NH2 | | 1733.92 | 868.48 | 1734.93 | 867.97 | 578.98 |
| SP6 | 14 Ac-LTF$r8AYWAQL$SAhL-NH2 | | 1729.98 | 865.98 | 1730.99 | 866 | 577.67 |
| SP7 | 15 Ac-LTF$r8AYWAQL$SAF-NH2 | | 1749.95 | 876.36 | 1750.96 | 875.98 | 584.32 |
| SP8 | 16 Ac-LTF$r8AYWAQL$SAI-NH2 | | 1715.97 | 859.02 | 1716.98 | 858.99 | 573 |
| SP9 | 17 Ac-LTF$r8AYWAQL$SAChg-NH2 | | 1741.98 | 871.98 | 1742.99 | 872 | 581.67 |
| SP10 | 18 Ac-LTF$r8AYWAQL$SAAib-NH2 | | 1687.93 | 845.36 | 1688.94 | 844.97 | 563.65 |
| SP11 | 19 Ac-LTF$r8AYWAQL$SAA-NH2 | | 1673.92 | 838.01 | 1674.93 | 837.97 | 558.98 |
| SP12 | 20 Ac-LTF$r8AYWA$L$S$Nle-NH2 | | 1767.04 | 884.77 | 1768.05 | 884.53 | 590.02 |
| SP13 | 21 Ac-LTF$r8AYWA$L$S$A-NH2 | | 1724.99 | 864.23 | 1726 | 863.5 | 576 |
| SP14 | 22 Ac-F$r8AYWEAc3cL$AANle-NH2 | | 1498.82 | 750.46 | 1499.83 | 750.42 | 500.61 |
| SP15 | 23 Ac-F$r8AYWEAc3cL$AAL-NH2 | | 1498.82 | 750.46 | 1499.83 | 750.42 | 500.61 |
| SP16 | 24 Ac-F$r8AYWEAc3cL$AAM-NH2 | | 1516.78 | 759.41 | 1517.79 | 759.4 | 506.6 |
| SP17 | 25 Ac-F$r8AYWEAc3cL$AAhL-NH2 | | 1512.84 | 757.49 | 1513.85 | 757.43 | 505.29 |
| SP18 | 26 Ac-F$r8AYWEAc3cL$AAF-NH2 | | 1532.81 | 767.48 | 1533.82 | 767.41 | 511.94 |
| SP19 | 27 Ac-F$r8AYWEAc3cL$AAI-NH2 | | 1498.82 | 750.39 | 1499.83 | 750.42 | 500.61 |
| SP20 | 28 Ac-FSr8AYWEAc3cLSAAChg-NH2 | | 1524.84 | 763.48 | 1525.85 | 763.43 | 509.29 |
| SP21 | 29 Ac-F$r8AYWEAc3cL$AACha-NH2 | | 1538.85 | 770.44 | 1539.86 | 770.43 | 513.96 |
| SP22 | 30 Ac-F$r8AYWEAc3cL$AAAib-NH2 | | 1470.79 | 736.84 | 1471.8 | 736.4 | 491.27 |
| SP23 | 31 Ac-LTF$r8AYWAQL$AAAibV-NH2 | | 1771.01 | 885.81 | 1772.02 | 886.51 | 591.34 |
| SP24 | 32 Ac-LTF$r8AYWAQL$AAAibV-NH2 | iso2 | 1771.01 | 886.26 | 1772.02 | 886.51 | 591.34 |
| SP25 | 33 Ac-LTF$r8AYWAQL$SAibAA-NH2 | | 1758.97 | 879.89 | 1759.98 | 880.49 | 587.33 |
| SP26 | 34 Ac-LTF$r8AYWAQL$SAibAA-NH2 | iso2 | 1758.97 | 880.34 | 1759.98 | 880.49 | 587.33 |
| SP27 | 35 Ac-HLTF$r8HHWHQL$AANleNle-NH2 | | 2056.15 | 1028.86 | 2057.16 | 1029.08 | 686.39 |
| SP28 | 36 Ac-DLTF$r8HHWHQL$RRLV-NH2 | | 2190.23 | 731.15 | 2191.24 | 1096.12 | 731.08 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP29 | 37 Ac-HHTF$r8HHWHQL$AAML-NH2 | | 2098.08 | 700.43 | 2099.09 | 1050.05 | 700.37 |
| SP30 | 38 Ac-F$r8HHWHQL$RRDCha-NH2 | | 1917.06 | 959.96 | 1918.07 | 959.54 | 640.03 |
| SP31 | 39 Ac-F$r8HHWHQL$HRFV-NH2 | | 1876.02 | 938.65 | 1877.03 | 939.02 | 626.35 |
| SP32 | 40 Ac-HLTF$r8HHWHQL$AAhLA-NH2 | | 2028.12 | 677.2 | 2029.13 | 1015.07 | 677.05 |
| SP33 | 41 Ac-DLTF$r8HHWHQL$RRChgl-NH2 | | 2230.26 | 1115.89 | 2231.27 | 1116.14 | 744.43 |
| SP34 | 42 Ac-DLTF$r8HHWHQL$RRChgl-NH2 | iso2 | 2230.26 | 1115.96 | 2231.27 | 1116.14 | 744.43 |
| SP35 | 43 Ac-HHTF$r8HHWHQL$AAChav-NH2 | | 2106.14 | 1053.95 | 2107.15 | 1054.08 | 703.05 |
| SP36 | 44 Ac-F$r8HHWHQL$RRDa-NH2 | | 1834.99 | 918.3 | 1836 | 918.5 | 612.67 |
| SP37 | 45 Ac-F$r8HHWHQL$HRAibG-NH2 | | 1771.95 | 886.77 | 1772.96 | 886.98 | 591.66 |
| SP38 | 46 Ac-F$r8AYWAQL$HHNleL-NH2 | | 1730.97 | 866.57 | 1731.98 | 866.49 | 578 |
| SP39 | 47 Ac-F$r8AYWSAL$HQANle-NH2 | | 1638.89 | 820.54 | 1639.9 | 820.45 | 547.3 |
| SP40 | 48 Ac-F$r8AYWVQLSQHChgl-NH2 | | 1776.01 | 889.44 | 1777.02 | 889.01 | 593.01 |
| SP41 | 49 Ac-F$r8AYWTAL$QQNlev-NH2 | | 1671.94 | 836.97 | 1672.95 | 836.98 | 558.32 |
| SP42 | 50 Ac-F$r8AYWYQL$HAibAa-NH2 | | 1686.89 | 844.52 | 1687.9 | 844.45 | 563.3 |
| SP43 | 51 Ac-LTF$r8AYWAQL$HHLa-NH2 | | 1903.05 | 952.27 | 1904.06 | 952.53 | 635.36 |
| SP44 | 52 Ac-LTF$r8AYWAQL$HHLa-NH2 | iso2 | 1903.05 | 952.27 | 1904.06 | 952.53 | 635.36 |
| SP45 | 53 Ac-LTF$r8AYWAQL$HQNlev-NH2 | | 1922.08 | 962.48 | 1923.09 | 962.05 | 641.7 |
| SP46 | 54 Ac-LTF$r8AYWAQL$HQNlev-NH2 | iso2 | 1922.08 | 962.4 | 1923.09 | 962.05 | 641.7 |
| SP47 | 55 Ac-LTF$r8AYWAQL$QQMl-NH2 | | 1945.05 | 973.95 | 1946.06 | 973.53 | 649.36 |
| SP48 | 56 Ac-LTF$r8AYWAQL$QQMl-NH2 | iso2 | 1945.05 | 973.88 | 1946.06 | 973.53 | 649.36 |
| SP49 | 57 Ac-LTF$r8AYWAQL$HAibhLV-NH2 | | 1893.09 | 948.31 | 1894.1 | 947.55 | 632.04 |
| SP50 | 58 Ac-LTF$r8AYWAQL$AHFA-NH2 | | 1871.01 | 937.4 | 1872.02 | 936.51 | 624.68 |
| SP51 | 59 Ac-HLTF$r8HHWHQL$AANlel-NH2 | | 2056.15 | 1028.79 | 2057.16 | 1029.08 | 686.39 |
| SP52 | 60 Ac-DLTF$r8HHWHQL$RRLa-NH2 | | 2162.2 | 721.82 | 2163.21 | 1082.11 | 721.74 |
| SP53 | 61 Ac-HHTF$r8HHWHQL$AAMv-NH2 | | 2084.07 | 1042.92 | 2085.08 | 1043.04 | 695.7 |
| SP54 | 62 Ac-F$r8HHWHQL$RRDA-NH2 | | 1834.99 | 612.74 | 1836 | 918.5 | 612.67 |
| SP55 | 63 Ac-F$r8HHWHQL$HRFCha-NH2 | | 1930.06 | 966.47 | 1931.07 | 966.04 | 644.36 |
| SP56 | 64 Ac-F$r8AYWEAL$AA-NHAm | | 1443.82 | 1445.71 | 1444.83 | 722.92 | 482.28 |
| SP57 | 65 Ac-F$r8AYWEAL$AA-NHiAm | | 1443.82 | 723.13 | 1444.83 | 722.92 | 482.28 |
| SP58 | 66 Ac-F$r8AYWEAL$AA-NHnPr3Ph | | 1491.82 | 747.3 | 1492.83 | 746.92 | 498.28 |
| SP59 | 67 Ac-F$r8AYWEAL$AA-NHnBu33Me | | 1457.83 | 1458.94 | 1458.84 | 729.92 | 486.95 |
| SP60 | 68 Ac-F$r8AYWEAL$AA-NHnPr | | 1415.79 | 709.28 | 1416.8 | 708.9 | 472.94 |
| SP61 | 69 Ac-F$r8AYWEAL$AA-NHnEt2Ch | | 1483.85 | 1485.77 | 1484.86 | 742.93 | 495.62 |
| SP62 | 70 Ac-F$r8AYWEAL$AA-NHnEt2Cp | | 1469.83 | 1470.78 | 1470.84 | 735.92 | 490.95 |
| SP63 | 71 Ac-F$r8AYWEAL$AA-NHHex | | 1457.83 | 730.19 | 1458.84 | 729.92 | 486.95 |
| SP64 | 72 Ac-LTF$r8AYWAQL$AAIA-NH2 | | 1771.01 | 885.81 | 1772.02 | 886.51 | 591.34 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP65 | 73 Ac-LTF$r8AYWAQL$AAIA-NH2 | iso2 | 1771.01 | 866.8 | 1772.02 | 886.51 | 591.34 |
| SP66 | 74 Ac-LTF$r8AYWAAL$AAMA-NH2 | | 1731.94 | 867.08 | 1732.95 | 866.98 | 578.32 |
| SP67 | 75 Ac-LTF$r8AYWAAL$AAMA-NH2 | iso2 | 1731.94 | 867.28 | 1732.95 | 866.98 | 578.32 |
| SP68 | 76 Ac-LTF$r8AYWAQL$AANleA-NH2 | | 1771.01 | 867.1 | 1772.02 | 886.51 | 591.34 |
| SP69 | 77 Ac-LTF$r8AYWAQL$AANleA-NH2 | iso2 | 1771.01 | 886.89 | 1772.02 | 886.51 | 591.34 |
| SP70 | 78 Ac-LTF$r8AYWAQL$AAIa-NH2 | | 1771.01 | 886.8 | 1772.02 | 886.51 | 591.34 |
| SP71 | 79 Ac-LTF$r8AYWAQL$AAIa-NH2 | iso2 | 1771.01 | 887.09 | 1772.02 | 886.51 | 591.34 |
| SP72 | 80 Ac-LTF$r8AYWAAL$AAMa-NH2 | | 1731.94 | 867.17 | 1732.95 | 866.98 | 578.32 |
| SP73 | 81 Ac-LTF$r8AYWAAL$AAMa-NH2 | iso2 | 1731.94 | 867.37 | 1732.95 | 866.98 | 578.32 |
| SP74 | 82 Ac-LTF$r8AYWAQL$AANlea-NH2 | | 1771.01 | 887.08 | 1772.02 | 886.51 | 591.34 |
| SP75 | 83 Ac-LTF$r8AYWAQL$AANlea-NH2 | iso2 | 1771.01 | 887.08 | 1772.02 | 886.51 | 591.34 |
| SP76 | 84 Ac-LTF$r8AYWAAL$AAIv-NH2 | | 1742.02 | 872.37 | 1743.03 | 872.02 | 581.68 |
| SP77 | 85 Ac-LTF$r8AYWAAL$AAIv-NH2 | iso2 | 1742.02 | 872.74 | 1743.03 | 872.02 | 581.68 |
| SP78 | 86 Ac-LTF$r8AYWAQL$AAMv-NH2 | | 1817 | 910.02 | 1818.01 | 909.51 | 606.67 |
| SP79 | 87 Ac-LTF$r8AYWAAL$AANlev-NH2 | | 1742.02 | 872.37 | 1743.03 | 872.02 | 581.68 |
| SP80 | 88 Ac-LTF$r8AYWAAL$AANlev-NH2 | iso2 | 1742.02 | 872.28 | 1743.03 | 872.02 | 581.68 |
| SP81 | 89 Ac-LTF$r8AYWAQL$AAIl-NH2 | | 1813.05 | 907.81 | 1814.06 | 907.53 | 605.36 |
| SP82 | 90 Ac-LTF$r8AYWAQL$AAIl-NH2 | iso2 | 1813.05 | 907.81 | 1814.06 | 907.53 | 605.36 |
| SP83 | 91 Ac-LTF$r8AYWAAL$AAMl-NH2 | | 1773.99 | 887.37 | 1775 | 888 | 592.34 |
| SP84 | 92 Ac-LTF$r8AYWAQL$AANlel-NH2 | | 1813.05 | 907.61 | 1814.06 | 907.53 | 605.36 |
| SP85 | 93 Ac-LTF$r8AYWAQL$AANlel-NH2 | iso2 | 1813.05 | 907.71 | 1814.06 | 907.53 | 605.36 |
| SP86 | 94 Ac-F$r8AYWEAL$AAMA-NH2 | | 1575.82 | 789.02 | 1576.83 | 788.92 | 526.28 |
| SP87 | 95 Ac-F$r8AYWEAL$AANleA-NH2 | | 1557.86 | 780.14 | 1558.87 | 779.94 | 520.29 |
| SP88 | 96 Ac-F$r8AYWEAL$AAIa-NH2 | | 1557.86 | 780.33 | 1558.87 | 779.94 | 520.29 |
| SP89 | 97 Ac-F$r8AYWEAL$AAMa-NH2 | | 1575.82 | 789.3 | 1576.83 | 788.92 | 526.28 |
| SP90 | 98 Ac-F$r8AYWEAL$AANlea-NH2 | | 1557.86 | 779.4 | 1558.87 | 779.94 | 520.29 |
| SP91 | 99 Ac-F$r8AYWEAL$AAIv-NH2 | | 1585.89 | 794.29 | 1586.9 | 793.95 | 529.64 |
| SP92 | 100 Ac-F$r8AYWEAL$AAMv-NH2 | | 1603.85 | 803.08 | 1604.86 | 802.93 | 535.62 |
| SP93 | 101 Ac-F$r8AYWEAL$AANlev-NH2 | | 1585.89 | 793.46 | 1586.9 | 793.95 | 529.64 |
| SP94 | 102 Ac-F$r8AYWEAL$AAIl-NH2 | | 1599.91 | 800.49 | 1600.92 | 800.96 | 534.31 |
| SP95 | 103 Ac-F$r8AYWEAL$AAMl-NH2 | | 1617.86 | 809.44 | 1618.87 | 809.94 | 540.29 |
| SP96 | 104 Ac-F$r8AYWEAL$AANlel-NH2 | | 1599.91 | 801.7 | 1600.92 | 800.96 | 534.31 |
| SP97 | 105 Ac-F$r8AYWEAL$AANlel-NH2 | iso2 | 1599.91 | 801.42 | 1600.92 | 800.96 | 534.31 |
| SP98 | 106 Ac-LTF$r8AY6clWAQL$SAA-NH2 | | 1707.88 | 855.72 | 1708.89 | 854.95 | 570.3 |
| SP99 | 107 Ac-LTF$r8AY6clWAQL$SAA-NH2 | iso2 | 1707.88 | 855.35 | 1708.89 | 854.95 | 570.3 |
| SP100 | 108 Ac-WTF$r8FYWSQL$AVAa-NH2 | | 1922.01 | 962.21 | 1923.02 | 962.01 | 641.68 |
| SP101 | 109 Ac-WTF$r8FYWSQL$AVAa-NH2 | iso2 | 1922.01 | 962.49 | 1923.02 | 962.01 | 641.68 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP102 | 110 Ac-WTF$r8VYWSQL$AVA-NH2 | | 1802.98 | 902.72 | 1803.99 | 902.5 | 602 |
| SP103 | 111 Ac-WTF$r8VYWSQL$AVA-NH2 | iso2 | 1802.98 | 903 | 1803.99 | 902.5 | 602 |
| SP104 | 112 Ac-WTF$r8FYWSQL$SAAa-NH2 | | 1909.98 | 956.47 | 1910.99 | 956 | 637.67 |
| SP105 | 113 Ac-WTF$r8FYWSQL$SAAa-NH2 | iso2 | 1909.98 | 956.47 | 1910.99 | 956 | 637.67 |
| SP106 | 114 Ac-WTF$r8VYWSQL$AVAaa-NH2 | | 1945.05 | 974.15 | 1946.06 | 973.53 | 649.36 |
| SP107 | 115 Ac-WTF$r8VYWSQL$AVAaa-NH2 | iso2 | 1945.05 | 973.78 | 1946.06 | 973.53 | 649.36 |
| SP108 | 116 Ac-LTF$r8AYWAQL$AVG-NH2 | | 1671.94 | 837.52 | 1672.95 | 836.98 | 558.32 |
| SP109 | 117 Ac-LTF$r8AYWAQL$AVG-NH2 | iso2 | 1671.94 | 837.21 | 1672.95 | 836.98 | 558.32 |
| SP110 | 118 Ac-LTF$r8AYWAQL$AVQ-NH2 | | 1742.98 | 872.74 | 1743.99 | 872.5 | 582 |
| SP111 | 119 Ac-LTF$r8AYWAQL$AVQ-NH2 | iso2 | 1742.98 | 872.74 | 1743.99 | 872.5 | 582 |
| SP112 | 120 Ac-LTF$r8AYWAQL$SAa-NH2 | | 1673.92 | 838.23 | 1674.93 | 837.97 | 558.98 |
| SP113 | 121 Ac-LTF$r8AYWAQL$SAa-NH2 | iso2 | 1673.92 | 838.32 | 1674.93 | 837.97 | 558.98 |
| SP114 | 122 Ac-LTF$r8AYWAQhL$SAA-NH2 | | 1687.93 | 844.37 | 1688.94 | 844.97 | 563.65 |
| SP115 | 123 Ac-LTF$r8AYWAQhL$SAA-NH2 | iso2 | 1687.93 | 844.81 | 1688.94 | 844.97 | 563.65 |
| SP116 | 124 Ac-LTF$r8AYWEQLStSA$-NH2 | | 1826 | 905.27 | 1827.01 | 914.01 | 609.67 |
| SP117 | 125 Ac-LTF$r8AYWAQL$SLA-NH2 | | 1715.97 | 858.48 | 1716.98 | 858.99 | 573 |
| SP118 | 126 Ac-LTF$r8AYWAQL$SLA-NH2 | iso2 | 1715.97 | 858.87 | 1716.98 | 858.99 | 573 |
| SP119 | 127 Ac-LTF$r8AYWAQL$SWA-NH2 | | 1788.96 | 895.21 | 1789.97 | 895.49 | 597.33 |
| SP120 | 128 Ac-LTF$r8AYWAQL$SWA-NH2 | iso2 | 1788.96 | 895.28 | 1789.97 | 895.49 | 597.33 |
| SP121 | 129 Ac-LTF$r8AYWAQL$SVS-NH2 | | 1717.94 | 859.84 | 1718.95 | 859.98 | 573.65 |
| SP122 | 130 Ac-LTF$r8AYWAQL$SAS-NH2 | | 1689.91 | 845.85 | 1690.92 | 845.96 | 564.31 |
| SP123 | 131 Ac-LTF$r8AYWAQL$SVG-NH2 | | 1687.93 | 844.81 | 1688.94 | 844.97 | 563.65 |
| SP124 | 132 Ac-ETF$r8VYWAQL$SAa-NH2 | | 1717.91 | 859.76 | 1718.92 | 859.96 | 573.64 |
| SP125 | 133 Ac-ETF$r8VYWAQL$SAA-NH2 | | 1717.91 | 859.84 | 1718.92 | 859.96 | 573.64 |
| SP126 | 134 Ac-ETF$r8VYWAQL$SVA-NH2 | | 1745.94 | 873.82 | 1746.95 | 873.98 | 582.99 |
| SP127 | 135 Ac-ETF$r8VYWAQL$SLA-NH2 | | 1759.96 | 880.85 | 1760.97 | 880.99 | 587.66 |
| SP128 | 136 Ac-ETF$r8VYWAQL$SWA-NH2 | | 1832.95 | 917.34 | 1833.96 | 917.48 | 611.99 |
| SP129 | 137 Ac-ETF$r8KYWAQL$SWA-NH2 | | 1861.98 | 931.92 | 1862.99 | 932 | 621.67 |
| SP130 | 138 Ac-ETF$r8VYWAQL$SVS-NH2 | | 1761.93 | 881.89 | 1762.94 | 881.97 | 588.32 |
| SP131 | 139 Ac-ETF$r8VYWAQL$SAS-NH2 | | 1733.9 | 867.83 | 1734.91 | 867.96 | 578.97 |
| SP132 | 140 Ac-ETF$r8VYWAQL$SVG-NH2 | | 1731.92 | 866.87 | 1732.93 | 866.97 | 578.31 |
| SP133 | 141 Ac-LTF$r8VYWAQL$SSa-NH2 | | 1717.94 | 859.47 | 1718.95 | 859.98 | 573.65 |
| SP134 | 142 Ac-ETF$r8VYWAQL$SSa-NH2 | | 1733.9 | 867.83 | 1734.91 | 867.96 | 578.97 |
| SP135 | 143 Ac-LTF$r8VYWAQL$SNa-NH2 | | 1744.96 | 873.38 | 1745.97 | 873.49 | 582.66 |
| SP136 | 144 Ac-ETF$r8VYWAQL$SNa-NH2 | | 1760.91 | 881.3 | 1761.92 | 881.46 | 587.98 |
| SP137 | 145 Ac-LTF$r8VYWAQL$SAa-NH2 | | 1701.95 | 851.84 | 1702.96 | 851.98 | 568.32 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP138 | 146 Ac-LTF$r8VYWAQL$SVA-NH2 | | 1729.98 | 865.53 | 1730.99 | 866 | 577.67 |
| SP139 | 147 Ac-LTF$r8VYWAQL$SVA-NH2 | iso2 | 1729.98 | 865.9 | 1730.99 | 866 | 577.67 |
| SP140 | 148 Ac-LTF$r8VYWAQL$SWA-NH2 | | 1816.99 | 909.42 | 1818 | 909.5 | 606.67 |
| SP141 | 149 Ac-LTF$r8VYWAQL$SVS-NH2 | | 1745.98 | 873.9 | 1746.99 | 874 | 583 |
| SP142 | 150 Ac-LTF$r8VYWAQL$SVS-NH2 | iso2 | 1745.98 | 873.9 | 1746.99 | 874 | 583 |
| SP143 | 151 Ac-LTF$r8VYWAQL$SAS-NH2 | | 1717.94 | 859.84 | 1718.95 | 859.98 | 573.65 |
| SP144 | 152 Ac-LTF$r8VYWAQL$SAS-NH2 | iso2 | 1717.94 | 859.91 | 1718.95 | 859.98 | 573.65 |
| SP145 | 153 Ac-LTF$r8VYWAQL$SVG-NH2 | | 1715.97 | 858.87 | 1716.98 | 858.99 | 573 |
| SP146 | 154 Ac-LTF$r8VYWAQL$SVG-NH2 | iso2 | 1715.97 | 858.87 | 1716.98 | 858.99 | 573 |
| SP147 | 155 Ac-LTF$r8EYWAQCha$SAA-NH2 | | 1771.96 | 886.85 | 1772.97 | 886.99 | 591.66 |
| SP148 | 156 Ac-LTF$r8EYWAQCha$SAA-NH2 | iso2 | 1771.96 | 886.85 | 1772.97 | 886.99 | 591.66 |
| SP149 | 157 Ac-LTF$r8EYWAQCpg$SAA-NH2 | | 1743.92 | 872.86 | 1744.93 | 872.97 | 582.31 |
| SP150 | 158 Ac-LTF$r8EYWAQCpg$SAA-NH2 | iso2 | 1743.92 | 872.86 | 1744.93 | 872.97 | 582.31 |
| SP151 | 159 Ac-LTF$r8EYWAQF$SAA-NH2 | | 1765.91 | 883.44 | 1766.92 | 883.96 | 589.64 |
| SP152 | 160 Ac-LTF$r8EYWAQF$SAA-NH2 | iso2 | 1765.91 | 883.89 | 1766.92 | 883.96 | 589.64 |
| SP153 | 161 Ac-LTF$r8EYWAQCba$SAA-NH2 | | 1743.92 | 872.42 | 1744.93 | 872.97 | 582.31 |
| SP154 | 162 Ac-LTF$r8EYWAQCba$SAA-NH2 | iso2 | 1743.92 | 873.39 | 1744.93 | 872.97 | 582.31 |
| SP155 | 163 Ac-LTF3Cl$r8EYWAQL$SAA-NH2 | | 1765.89 | 883.89 | 1766.9 | 883.95 | 589.64 |
| SP156 | 164 Ac-LTF3Cl$r8EYWAQL$SAA-NH2 | iso2 | 1765.89 | 883.96 | 1766.9 | 883.95 | 589.64 |
| SP157 | 165 Ac-LTF34F2$r8EYWAQL$SAA-NH2 | | 1767.91 | 884.48 | 1768.92 | 884.96 | 590.31 |
| SP158 | 166 Ac-LTF34F2$r8EYWAQL$SAA-NH2 | iso2 | 1767.91 | 884.48 | 1768.92 | 884.96 | 590.31 |
| SP159 | 167 Ac-LTF34F2$r8EYWAQhL$SAA-NH2 | | 1781.92 | 891.44 | 1782.93 | 891.97 | 594.98 |
| SP160 | 168 Ac-LTF34F2$r8EYWAQhL$SAA-NH2 | iso2 | 1781.92 | 891.88 | 1782.93 | 891.97 | 594.98 |
| SP161 | 169 Ac-ETF$r8EYWAQL$SAA-NH2 | | 1747.88 | 874.34 | 1748.89 | 874.95 | 583.63 |
| SP162 | 170 Ac-LTF$r8AYWVQL$SAA-NH2 | | 1701.95 | 851.4 | 1702.96 | 851.98 | 568.32 |
| SP163 | 171 Ac-LTF$r8AHWAQL$SAA-NH2 | | 1647.91 | 824.83 | 1648.92 | 824.96 | 550.31 |
| SP164 | 172 Ac-LTF$r8AEWAQL$SAA-NH2 | | 1639.9 | 820.39 | 1640.91 | 820.96 | 547.64 |
| SP165 | 173 Ac-LTF$r8ASWAQL$SAA-NH2 | | 1597.89 | 799.38 | 1598.9 | 799.95 | 533.64 |
| SP166 | 174 Ac-LTF$r8AEWAQL$SAA-NH2 | iso2 | 1639.9 | 820.39 | 1640.91 | 820.96 | 547.64 |
| SP167 | 175 Ac-LTF$r8ASWAQL$SAA-NH2 | iso2 | 1597.89 | 800.31 | 1598.9 | 799.95 | 533.64 |
| SP168 | 176 Ac-LTF$r8AF4coohWAQL$SAA-NH2 | | 1701.91 | 851.4 | 1702.92 | 851.96 | 568.31 |
| SP169 | 177 Ac-LTF$r8AF4coohWAQL$SAA-NH2 | iso2 | 1701.91 | 851.4 | 1702.92 | 851.96 | 568.31 |
| SP170 | 178 Ac-LTF$r8AHWAQL$AAIa-NH2 | | 1745 | 874.13 | 1746.01 | 873.51 | 582.67 |
| SP171 | 179 Ac-ITF$r8FYWAQL$AAIa-NH2 | | 1847.04 | 923.92 | 1848.05 | 924.53 | 616.69 |
| SP172 | 180 Ac-ITF$r8EHWAQL$AAIa-NH2 | | 1803.01 | 903.17 | 1804.02 | 902.51 | 602.01 |
| SP173 | 181 Ac-ITF$r8EHWAQL$AAIa-NH2 | iso2 | 1803.01 | 903.17 | 1804.02 | 902.51 | 602.01 |
| SP174 | 182 Ac-ETF$r8EHWAQL$AAIa-NH2 | | 1818.97 | 910.76 | 1819.98 | 910.49 | 607.33 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP175 | 183 Ac-ETF$r8EHWAQL$AAIa-NH2 | iso2 | 1818.97 | 910.85 | 1819.98 | 910.49 | 607.33 |
| SP176 | 184 Ac-LTF$r8AHWVQL$AAIa-NH2 | | 1773.03 | 888.09 | 1774.04 | 887.52 | 592.02 |
| SP177 | 185 Ac-ITF$r8FYWVQL$AAIa-NH2 | | 1875.07 | 939.16 | 1876.08 | 938.54 | 626.03 |
| SP178 | 186 Ac-ITF$r8EYWVQL$AAIa-NH2 | | 1857.04 | 929.83 | 1858.05 | 929.53 | 620.02 |
| SP179 | 187 Ac-ITF$r8EHWVQL$AAIa-NH2 | | 1831.04 | 916.86 | 1832.05 | 916.53 | 611.35 |
| SP180 | 188 Ac-LTF$r8AEWAQL$AAIa-NH2 | | 1736.99 | 869.87 | 1738 | 869.5 | 580 |
| SP181 | 189 Ac-LTF$r8AF4coohWAQL$AAIa-NH2 | | 1799 | 900.17 | 1800.01 | 900.51 | 600.67 |
| SP182 | 190 Ac-LTF$r8AF4coohWAQL$AAIa-NH2 | iso2 | 1799 | 900.24 | 1800.01 | 900.51 | 600.67 |
| SP183 | 191 Ac-LTF$r8AHWAQL$AHFA-NH2 | | 1845.01 | 923.89 | 1846.02 | 923.51 | 616.01 |
| SP184 | 192 Ac-ITF$r8FYWAQL$AHFA-NH2 | | 1947.05 | 975.05 | 1948.06 | 974.53 | 650.02 |
| SP185 | 193 Ac-ITF$r8FYWAQL$AHFA-NH2 | iso2 | 1947.05 | 976.07 | 1948.06 | 974.53 | 650.02 |
| SP186 | 194 Ac-ITF$r8FHWAQL$AEFA-NH2 | | 1913.02 | 958.12 | 1914.03 | 957.52 | 638.68 |
| SP187 | 195 Ac-ITF$r8FHWAQL$AEFA-NH2 | iso2 | 1913.02 | 957.86 | 1914.03 | 957.52 | 638.68 |
| SP188 | 196 Ac-ITF$r8EHWAQL$AHFA-NH2 | | 1903.01 | 952.94 | 1904.02 | 952.51 | 635.34 |
| SP189 | 197 Ac-ITF$r8EHWAQL$AHFA-NH2 | iso2 | 1903.01 | 953.87 | 1904.02 | 952.51 | 635.34 |
| SP190 | 198 Ac-LTF$r8AHWVQL$AHFA-NH2 | | 1873.04 | 937.86 | 1874.05 | 937.53 | 625.35 |
| SP191 | 199 Ac-ITF$r8FYWVQL$AHFA-NH2 | | 1975.08 | 988.83 | 1976.09 | 988.55 | 659.37 |
| SP192 | 200 Ac-ITF$r8EYWVQL$AHFA-NH2 | | 1957.05 | 979.35 | 1958.06 | 979.53 | 653.36 |
| SP193 | 201 Ac-ITF$r8EHWVQL$AHFA-NH2 | | 1931.05 | 967 | 1932.06 | 966.53 | 644.69 |
| SP194 | 202 Ac-ITF$r8EHWVQL$AHFA-NH2 | iso2 | 1931.05 | 967.93 | 1932.06 | 966.53 | 644.69 |
| SP195 | 203 Ac-ETF$r8EYWAAL$SAA-NH2 | | 1690.86 | 845.85 | 1691.87 | 846.44 | 564.63 |
| SP196 | 204 Ac-LTF$r8AYWVAL$SAA-NH2 | | 1644.93 | 824.08 | 1645.94 | 823.47 | 549.32 |
| SP197 | 205 Ac-LTF$r8AHWAAL$SAA-NH2 | | 1590.89 | 796.88 | 1591.9 | 796.45 | 531.3 |
| SP198 | 206 Ac-LTF$r8AEWAAL$SAA-NH2 | | 1582.88 | 791.9 | 1583.89 | 792.45 | 528.63 |
| SP199 | 207 Ac-LTF$r8AEWAAL$SAA-NH2 | iso2 | 1582.88 | 791.9 | 1583.89 | 792.45 | 528.63 |
| SP200 | 208 Ac-LTF$r8ASWAAL$SAA-NH2 | | 1540.87 | 770.74 | 1541.88 | 771.44 | 514.63 |
| SP201 | 209 Ac-LTF$r8ASWAAL$SAA-NH2 | iso2 | 1540.87 | 770.88 | 1541.88 | 771.44 | 514.63 |
| SP202 | 210 Ac-LTF$r8AYWAAL$AAIa-NH2 | | 1713.99 | 857.39 | 1715 | 858 | 572.34 |
| SP203 | 211 Ac-LTF$r8AYWAAL$AAIa-NH2 | iso2 | 1713.99 | 857.84 | 1715 | 858 | 572.34 |
| SP204 | 212 Ac-LTF$r8AYWAAL$AHFA-NH2 | | 1813.99 | 907.86 | 1815 | 908 | 605.67 |
| SP205 | 213 Ac-LTF$r8EHWAQL$AHIa-NH2 | | 1869.03 | 936.1 | 1870.04 | 935.52 | 624.02 |
| SP206 | 214 Ac-LTF$r8EHWAQL$AHIa-NH2 | iso2 | 1869.03 | 937.03 | 1870.04 | 935.52 | 624.02 |
| SP207 | 215 Ac-LTF$r8AHWAQL$AHIa-NH2 | | 1811.03 | 906.87 | 1812.04 | 906.52 | 604.68 |
| SP208 | 216 Ac-LTF$r8EYWAQL$AHIa-NH2 | | 1895.04 | 949.15 | 1896.05 | 948.53 | 632.69 |
| SP209 | 217 Ac-LTF$r8AYWAQL$AAFa-NH2 | | 1804.99 | 903.2 | 1806 | 903.5 | 602.67 |
| SP210 | 218 Ac-LTF$r8AYWAQL$AAFa-NH2 | iso2 | 1804.99 | 903.28 | 1806 | 903.5 | 602.67 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP211 | 219 Ac-LTF$r8AYWAQL$AAWa-NH2 | | 1844 | 922.81 | 1845.01 | 923.01 | 615.67 |
| SP212 | 220 Ac-LTF$r8AYWAQL$AAVa-NH2 | | 1756.99 | 878.86 | 1758 | 879.5 | 586.67 |
| SP213 | 221 Ac-LTF$r8AYWAQL$AAVa-NH2 | iso2 | 1756.99 | 879.3 | 1758 | 879.5 | 586.67 |
| SP214 | 222 Ac-LTF$r8AYWAQL$AALa-NH2 | | 1771.01 | 886.26 | 1772.02 | 886.51 | 591.34 |
| SP215 | 223 Ac-LTF$r8AYWAQL$AALa-NH2 | iso2 | 1771.01 | 886.33 | 1772.02 | 886.51 | 591.34 |
| SP216 | 224 Ac-LTF$r8EYWAQL$AAIa-NH2 | | 1829.01 | 914.89 | 1830.02 | 915.51 | 610.68 |
| SP217 | 225 Ac-LTF$r8EYWAQL$AAIa-NH2 | iso2 | 1829.01 | 915.34 | 1830.02 | 915.51 | 610.68 |
| SP218 | 226 Ac-LTF$r8EYWAQL$AAFa-NH2 | | 1863 | 932.87 | 1864.01 | 932.51 | 622.01 |
| SP219 | 227 Ac-LTF$r8EYWAQL$AAFa-NH2 | iso2 | 1863 | 932.87 | 1864.01 | 932.51 | 622.01 |
| SP220 | 228 Ac-LTF$r8EYWAQL$AAVa-NH2 | | 1815 | 908.23 | 1816.01 | 908.51 | 606.01 |
| SP221 | 229 Ac-LTF$r8EYWAQL$AAVa-NH2 | iso2 | 1815 | 908.31 | 1816.01 | 908.51 | 606.01 |
| SP222 | 230 Ac-LTF$r8EHWAQL$AAIa-NH2 | | 1803.01 | 903.17 | 1804.02 | 902.51 | 602.01 |
| SP223 | 231 Ac-LTF$r8EHWAQL$AAIa-NH2 | iso2 | 1803.01 | 902.8 | 1804.02 | 902.51 | 602.01 |
| SP224 | 232 Ac-LTF$r8EHWAQL$AAWa-NH2 | | 1876 | 939.34 | 1877.01 | 939.01 | 626.34 |
| SP225 | 233 Ac-LTF$r8EHWAQL$AAWa-NH2 | iso2 | 1876 | 939.62 | 1877.01 | 939.01 | 626.34 |
| SP226 | 234 Ac-LTF$r8EHWAQL$AALa-NH2 | | 1803.01 | 902.8 | 1804.02 | 902.51 | 602.01 |
| SP227 | 235 Ac-LTF$r8EHWAQL$AALa-NH2 | iso2 | 1803.01 | 902.9 | 1804.02 | 902.51 | 602.01 |
| SP228 | 236 Ac-ETF$r8EHWVQL$AALa-NH2 | | 1847 | 924.82 | 1848.01 | 924.51 | 616.67 |
| SP229 | 237 Ac-LTF$r8AYWAQL$AAAa-NH2 | | 1728.96 | 865.89 | 1729.97 | 865.49 | 577.33 |
| SP230 | 238 Ac-LTF$r8AYWAQL$AAAa-NH2 | iso2 | 1728.96 | 865.89 | 1729.97 | 865.49 | 577.33 |
| SP231 | 239 Ac-LTF$r8AYWAQL$AAAibA-NH2 | | 1742.98 | 872.83 | 1743.99 | 872.5 | 582 |
| SP232 | 240 Ac-LTF$r8AYWAQL$AAAibA-NH2 | iso2 | 1742.98 | 872.92 | 1743.99 | 872.5 | 582 |
| SP233 | 241 Ac-LTF$r8AYWAQL$AAAAa-NH2 | | 1800 | 901.42 | 1801.01 | 901.01 | 601.01 |
| SP234 | 242 Ac-LTF$r5AYWAQL$s8AAIa-NH2 | | 1771.01 | 887.17 | 1772.02 | 886.51 | 591.34 |
| SP235 | 243 Ac-LTF$r5AYWAQL$s8SAA-NH2 | | 1673.92 | 838.33 | 1674.93 | 837.97 | 558.98 |
| SP236 | 244 Ac-LTF$r8AYWAQCba$AANleA-NH2 | | 1783.01 | 892.64 | 1784.02 | 892.51 | 595.34 |
| SP237 | 245 Ac-ETF$r8AYWAQCba$AANleA-NH2 | | 1798.97 | 900.59 | 1799.98 | 900.49 | 600.66 |
| SP238 | 246 Ac-LTF$r8EYWAQCba$AANleA-NH2 | | 1841.01 | 922.05 | 1842.02 | 921.51 | 614.68 |
| SP239 | 247 Ac-LTF$r8AYWAQCba$AWNleA-NH2 | | 1898.05 | 950.46 | 1899.06 | 950.03 | 633.69 |
| SP240 | 248 Ac-ETF$r8AYWAQCba$AWNleA-NH2 | | 1914.01 | 958.11 | 1915.02 | 958.01 | 639.01 |
| SP241 | 249 Ac-LTF$r8EYWAQCba$AWNleA-NH2 | | 1956.06 | 950.62 | 1957.07 | 979.04 | 653.03 |
| SP242 | 250 Ac-LTF$r8EYWAQCba$SAFA-NH2 | | 1890.99 | 946.55 | 1892 | 946.5 | 631.34 |
| SP243 | 251 Ac-LTF34F2$r8EYWAQCba$SANleA-NH2 | | 1892.99 | 947.57 | 1894 | 947.5 | 632 |
| SP244 | 252 Ac-LTF$r8EF4coohWAQCba$SANleA-NH2 | | 1885 | 943.59 | 1886.01 | 943.51 | 629.34 |
| SP245 | 253 Ac-LTF$r8EYWSQCba$SANleA-NH2 | | 1873 | 937.58 | 1874.01 | 937.51 | 625.34 |
| SP246 | 254 Ac-LTF$r8EYWWQCba$SANleA-NH2 | | 1972.05 | 987.61 | 1973.06 | 987.03 | 658.36 |
| SP247 | 255 Ac-LTF$r8EYWAQCba$AAIa-NH2 | | 1841.01 | 922.05 | 1842.02 | 921.51 | 614.68 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP248 | 256 Ac-LTF34F2$r8EYWAQCba$AAIa-NH2 | | 1876.99 | 939.99 | 1878 | 939.5 | 626.67 |
| SP249 | 257 Ac-LTF$r8EF4coohWAQCba$AAIa-NH2 | | 1869.01 | 935.64 | 1870.02 | 935.51 | 624.01 |
| SP250 | 258 Pam-ETF$r8EYWAQCba$SAA-NH2 | | 1956.1 | 979.57 | 1957.11 | 979.06 | 653.04 |
| SP251 | 259 Ac-LThF$r8EFWAQCba$SAA-NH2 | | 1741.94 | 872.11 | 1742.95 | 871.98 | 581.65 |
| SP252 | 260 Ac-LTA$r8EYWAQCba$SAA-NH2 | | 1667.89 | 835.4 | 1668.9 | 834.95 | 556.97 |
| SP253 | 261 Ac-LTF$r8EYAAQCba$SAA-NH2 | | 1628.88 | 815.61 | 1629.89 | 815.45 | 543.97 |
| SP254 | 262 Ac-LTF$r8EY2NalAQCba$SAA-NH2 | | 1754.93 | 879.04 | 1755.94 | 878.47 | 585.98 |
| SP255 | 263 Ac-LTF$r8AYWAQCba$SAA-NH2 | | 1685.92 | 844.71 | 1686.93 | 843.97 | 562.98 |
| SP256 | 264 Ac-LTF$r8EYWAQCba$SAF-NH2 | | 1819.96 | 911.41 | 1820.97 | 910.99 | 607.66 |
| SP257 | 265 Ac-LTF$r8EYWAQCba$SAFa-NH2 | | 1890.99 | 947.41 | 1892 | 946.5 | 631.34 |
| SP258 | 266 Ac-LTF$r8AYWAQCba$SAF-NH2 | | 1761.95 | 882.73 | 1762.96 | 881.98 | 588.32 |
| SP259 | 267 Ac-LTF34F2$r8AYWAQCba$SAF-NH2 | | 1797.93 | 900.87 | 1798.94 | 899.97 | 600.32 |
| SP260 | 268 Ac-LTF$r8AF4coohWAQCba$SAF-NH2 | | 1789.94 | 896.43 | 1790.95 | 895.98 | 597.65 |
| SP261 | 269 Ac-LTF$r8EY6clWAQCba$SAF-NH2 | | 1853.92 | 929.27 | 1854.93 | 927.97 | 618.98 |
| SP262 | 270 Ac-LTF$r8AYWSQCba$SAF-NH2 | | 1777.94 | 890.87 | 1778.95 | 889.98 | 593.65 |
| SP263 | 271 Ac-LTF$r8AYWWQCba$SAF-NH2 | | 1876.99 | 939.91 | 1878 | 939.5 | 626.67 |
| SP264 | 272 Ac-LTF$r8AYWAQCba$AAIa-NH2 | | 1783.01 | 893.19 | 1784.02 | 892.51 | 595.34 |
| SP265 | 273 Ac-LTF34F2$r8AYWAQCba$AAIa-NH2 | | 1818.99 | 911.23 | 1820 | 910.5 | 607.34 |
| SP266 | 274 Ac-LTF$r8AY6clWAQCba$AAIa-NH2 | | 1816.97 | 909.84 | 1817.98 | 909.49 | 606.66 |
| SP267 | 275 Ac-LTF$r8AF4coohWAQCba$AAIa-NH2 | | 1811 | 906.88 | 1812.01 | 906.51 | 604.67 |
| SP268 | 276 Ac-LTF$r8EYWAQCba$AAFa-NH2 | | 1875 | 938.6 | 1876.01 | 938.51 | 626.01 |
| SP269 | 277 Ac-LTF$r8EYWAQCba$AAFa-NH2 | iso2 | 1875 | 938.6 | 1876.01 | 938.51 | 626.01 |
| SP270 | 278 Ac-ETF$r8AYWAQCba$AWNlea-NH2 | | 1914.01 | 958.42 | 1915.02 | 958.01 | 639.01 |
| SP271 | 279 Ac-LTF$r8EYWAQCba$AWNlea-NH2 | | 1956.06 | 979.42 | 1957.07 | 979.04 | 653.03 |
| SP272 | 280 Ac-ETF$r8EYWAQCba$AWNlea-NH2 | | 1972.01 | 987.06 | 1973.02 | 987.01 | 658.34 |
| SP273 | 281 Ac-ETF$r8EYWAQCba$AWNlea-NH2 | iso2 | 1972.01 | 987.06 | 1973.02 | 987.01 | 658.34 |
| SP274 | 282 Ac-LTF$r8AYWAQCba$SAFa-NH2 | | 1832.99 | 917.89 | 1834 | 917.5 | 612 |
| SP275 | 283 Ac-LTF$r8AYWAQCba$SAFa-NH2 | iso2 | 1832.99 | 918.07 | 1834 | 917.5 | 612 |
| SP276 | 284 Ac-ETF$r8AYWAQL$AWNlea-NH2 | | 1902.01 | 952.22 | 1903.02 | 952.01 | 635.01 |
| SP277 | 285 Ac-LTF$r8EYWAQL$AWNlea-NH2 | | 1944.06 | 973.5 | 1945.07 | 973.04 | 649.03 |
| SP278 | 286 Ac-ETF$r8EYWAQL$AWNlea-NH2 | | 1960.01 | 981.46 | 1961.02 | 981.01 | 654.34 |
| SP279 | 287 Dmaac-LTF$r8EYWAQhL$SAA-NH2 | | 1788.98 | 896.06 | 1789.99 | 895.5 | 597.33 |
| SP280 | 288 Hexac-LTF$r8EYWAQhL$SAA-NH2 | | 1802 | 902.9 | 1803.01 | 902.01 | 601.67 |
| SP281 | 289 Napac-LTF$r8EYWAQhL$SAA-NH2 | | 1871.99 | 937.58 | 1873 | 937 | 625 |
| SP282 | 290 Decac-LTF$r8EYWAQhL$SAA-NH2 | | 1858.06 | 930.55 | 1859.07 | 930.04 | 620.36 |
| SP283 | 291 Admac-LTF$r8EYWAQhL$SAA-NH2 | | 1866.03 | 934.07 | 1867.04 | 934.02 | 623.02 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP284 292 Tmac-LTF$r8EYWAQhL$SAA-NH2 | | | 1787.99 | 895.41 | 1789 | 895 | 597 |
| SP285 293 Pam-LTF$r8EYWAQhL$SAA-NH2 | | | 1942.16 | 972.08 | 1943.17 | 972.09 | 648.39 |
| SP286 294 Ac-LTF$r8AYWAQCba$AANleA-NH2 | | iso2 | 1783.01 | 892.64 | 1784.02 | 892.51 | 595.34 |
| SP287 295 Ac-LTF34F2$r8EYWAQCba$AAIa-NH2 | | iso2 | 1876.99 | 939.62 | 1878 | 939.5 | 626.67 |
| SP288 296 Ac-LTF34F2$r8EYWAQCba$SAA-NH2 | | | 1779.91 | 892.07 | 1780.92 | 890.96 | 594.31 |
| SP289 297 Ac-LTF34F2$r8EYWAQCba$SAA-NH2 | | iso2 | 1779.91 | 891.61 | 1780.92 | 890.96 | 594.31 |
| SP290 298 Ac-LTF$r8EF4coohWAQCba$SAA-NH2 | | | 1771.92 | 887.54 | 1772.93 | 886.97 | 591.65 |
| SP291 299 Ac-LTF$r8EF4coohWAQCba$SAA-NH2 | | iso2 | 1771.92 | 887.63 | 1772.93 | 886.97 | 591.65 |
| SP292 300 Ac-LTF$r8EYWSQCba$SAA-NH2 | | | 1759.92 | 881.9 | 1760.93 | 880.97 | 587.65 |
| SP293 301 Ac-LTF$r8EYWSQCba$SAA-NH2 | | iso2 | 1759.92 | 881.9 | 1760.93 | 880.97 | 587.65 |
| SP294 302 Ac-LTF$r8EYWAQhL$SAA-NH2 | | | 1745.94 | 875.05 | 1746.95 | 873.98 | 582.99 |
| SP295 303 Ac-LTF$r8AYWAQhL$SAF-NH2 | | | 1763.97 | 884.02 | 1764.98 | 882.99 | 589 |
| SP296 304 Ac-LTF$r8AYWAQhL$SAF-NH2 | | iso2 | 1763.97 | 883.56 | 1764.98 | 882.99 | 589 |
| SP297 305 Ac-LTF34F2$r8AYWAQhL$SAA-NH2 | | | 1723.92 | 863.67 | 1724.93 | 862.97 | 575.65 |
| SP298 306 Ac-LTF34F2$r8AYWAQhL$SAA-NH2 | | iso2 | 1723.92 | 864.04 | 1724.93 | 862.97 | 575.65 |
| SP299 307 Ac-LTF$r8AF4coohWAQhL$SAA-NH2 | | | 1715.93 | 859.44 | 1716.94 | 858.97 | 572.98 |
| SP300 308 Ac-LTF$r8AF4coohWAQhL$SAA-NH2 | | iso2 | 1715.93 | 859.6 | 1716.94 | 858.97 | 572.98 |
| SP301 309 Ac-LTF$r8AYWSQhL$SAA-NH2 | | | 1703.93 | 853.96 | 1704.94 | 852.97 | 568.98 |
| SP302 310 Ac-LTF$r8AYWSQhL$SAA-NH2 | | iso2 | 1703.93 | 853.59 | 1704.94 | 852.97 | 568.98 |
| SP303 311 Ac-LTF$r8EYWAQL$AANleA-NH2 | | | 1829.01 | 915.45 | 1830.02 | 915.51 | 610.68 |
| SP304 312 Ac-LTF34F2$r8AYWAQL$AANleA-NH2 | | | 1806.99 | 904.58 | 1808 | 904.5 | 603.34 |
| SP305 313 Ac-LTF$r8AF4coohWAQL$AANleA-NH2 | | | 1799 | 901.6 | 1800.01 | 900.51 | 600.67 |
| SP306 314 Ac-LTF$r8AYWSQL$AANleA-NH2 | | | 1787 | 894.75 | 1788.01 | 894.51 | 596.67 |
| SP307 315 Ac-LTF34F2$r8AYWAQhL$AANleA-NH2 | | | 1821 | 911.79 | 1822.01 | 911.51 | 608.01 |
| SP308 316 Ac-LTF34F2$r8AYWAQhL$AANleA-NH2 | | iso2 | 1821 | 912.61 | 1822.01 | 911.51 | 608.01 |
| SP309 317 Ac-LTF$r8AF4coohWAQhL$AANleA-NH2 | | | 1813.02 | 907.95 | 1814.03 | 907.52 | 605.35 |
| SP310 318 Ac-LTF$r8AF4coohWAQhL$AANleA-NH2 | | iso2 | 1813.02 | 908.54 | 1814.03 | 907.52 | 605.35 |
| SP311 319 Ac-LTF$r8AYWSQhL$AANleA-NH2 | | | 1801.02 | 901.84 | 1802.03 | 901.52 | 601.35 |
| SP312 320 Ac-LTF$r8AYWSQhL$AANleA-NH2 | | iso2 | 1801.02 | 902.62 | 1802.03 | 901.52 | 601.35 |
| SP313 321 Ac-LTF$r8AYWAQhL$AAAAa-NH2 | | | 1814.01 | 908.63 | 1815.02 | 908.01 | 605.68 |
| SP314 322 Ac-LTF$r8AYWAQhL$AAAAa-NH2 | | iso2 | 1814.01 | 908.34 | 1815.02 | 908.01 | 605.68 |
| SP315 323 Ac-LTF$r8AYWAQL$AAAAAa-NH2 | | | 1871.04 | 936.94 | 1872.05 | 936.53 | 624.69 |
| SP316 324 Ac-LTF$r8AYWAQL$AAAAAAa-NH2 | | iso2 | 1942.07 | 972.5 | 1943.08 | 972.04 | 648.37 |
| SP317 325 Ac-LTF$r8AYWAQL$AAAAAAa-NH2 | | iso1 | 1942.07 | 972.5 | 1943.08 | 972.04 | 648.37 |
| SP318 326 Ac-LTF$r8EYWAQhL$AANleA-NH2 | | | 1843.03 | 922.54 | 1844.04 | 922.52 | 615.35 |
| SP319 327 Ac-AATF$r8AYWAQL$AANleA-NH2 | | | 1800 | 901.39 | 1801.01 | 901.01 | 601.01 |
| SP320 328 Ac-LTF$r8AYWAQL$AANleAA-NH2 | | | 1842.04 | 922.45 | 1843.05 | 922.03 | 615.02 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP321329 | Ac-ALTF$r8AYWAQL$AANleAA-NH2 | | 1913.08 | 957.94 | 1914.09 | 957.55 | 638.7 |
| SP322330 | Ac-LTF$r8AYWAQCba$AANleAA-NH2 | | 1854.04 | 928.43 | 1855.05 | 928.03 | 619.02 |
| SP323331 | Ac-LTF$r8AYWAQhL$AANleAA-NH2 | | 1856.06 | 929.4 | 1857.07 | 929.04 | 619.69 |
| SP324332 | Ac-LTF$r8EYWAQCba$SAAA-NH2 | | 1814.96 | 909.37 | 1815.97 | 908.49 | 605.99 |
| SP325333 | Ac-LTF$r8EYWAQCba$SAAA-NH2 | iso2 | 1814.96 | 909.37 | 1815.97 | 908.49 | 605.99 |
| SP326334 | Ac-LTF$r8EYWAQCba$SAAAA-NH2 | | 1886 | 944.61 | 1887.01 | 944.01 | 629.67 |
| SP327335 | Ac-LTF$r8EYWAQCba$SAAAA-NH2 | iso2 | 1886 | 944.61 | 1887.01 | 944.01 | 629.67 |
| SP328336 | Ac-ALTF$r8EYWAQCba$SAA-NH2 | | 1814.96 | 909.09 | 1815.97 | 908.49 | 605.99 |
| SP329337 | Ac-ALTF$r8EYWAQCba$SAAA-NH2 | | 1886 | 944.61 | 1887.01 | 944.01 | 629.67 |
| SP330338 | Ac-ALTF$r8EYWAQCba$SAA-NH2 | iso2 | 1814.96 | 909.09 | 1815.97 | 908.49 | 605.99 |
| SP331339 | Ac-LTF$r8EYWAQL$AAAAAa-NH2 | iso2 | 1929.04 | 966.08 | 1930.05 | 965.53 | 644.02 |
| SP332340 | Ac-LTF$r8EY6clWAQCba$SAA-NH2 | | 1777.89 | 890.78 | 1778.9 | 889.95 | 593.64 |
| SP333341 | Ac-LTF$r8EF4cooh6clWAQCbaSSANleA-NH2 | | 1918.96 | 961.27 | 1919.97 | 960.49 | 640.66 |
| SP334342 | Ac-LTF$r8EF4cooh6clWAQCbaSSANleA-NH2 | iso2 | 1918.96 | 961.27 | 1919.97 | 960.49 | 640.66 |
| SP335343 | Ac-LTF$r8EF4cooh6clWAQCba$AAIa-NH2 | | 1902.97 | 953.03 | 1903.98 | 952.49 | 635.33 |
| SP336344 | Ac-LTF$r8EF4cooh6clWAQCba$AAIa-NH2 | iso2 | 1902.97 | 953.13 | 1903.98 | 952.49 | 635.33 |
| SP337345 | Ac-LTF$r8AY6clWAQL$AAAAAa-NH2 | | 1905 | 954.61 | 1906.01 | 953.51 | 636.01 |
| SP338346 | Ac-LTF$r8AY6clWAQL$AAAAAa-NH2 | iso2 | 1905 | 954.9 | 1906.01 | 953.51 | 636.01 |
| SP339347 | Ac-F$r8AY6clWEAL$AAAAAAa-NH2 | | 1762.89 | 883.01 | 1763.9 | 882.45 | 588.64 |
| SP340348 | Ac-ETF$r8EYWAQL$AAAAAa-NH2 | | 1945 | 974.31 | 1946.01 | 973.51 | 649.34 |
| SP341349 | Ac-ETF$r8EYWAQL$AAAAAa-NH2 | iso2 | 1945 | 974.49 | 1946.01 | 973.51 | 649.34 |
| SP342350 | Ac-LTF$r8EYWAQL$AAAAAAa-NH2 | | 2000.08 | 1001.6 | 2001.09 | 1001.05 | 667.7 |
| SP343351 | Ac-LTF$r8EYWAQL$AAAAAAa-NH2 | iso2 | 2000.08 | 1001.6 | 2001.09 | 1001.05 | 667.7 |
| SP344352 | Ac-LTF$r8AYWAQL$AANleAAa-NH2 | | 1913.08 | 958.58 | 1914.09 | 957.55 | 638.7 |
| SP345353 | Ac-LTF$r8AYWAQL$AANleAAa-NH2 | iso2 | 1913.08 | 958.58 | 1914.09 | 957.55 | 638.7 |
| SP346354 | Ac-LTF$r8EYWAQCba$AAAAAa-NH2 | | 1941.04 | 972.55 | 1942.05 | 971.53 | 648.02 |
| SP347355 | Ac-LTF$r8EYWAQCba$AAAAAa-NH2 | iso2 | 1941.04 | 972.55 | 1942.05 | 971.53 | 648.02 |
| SP348356 | Ac-LTF$r8EF4coohWAQCba$AAAAAa-NH2 | | 1969.04 | 986.33 | 1970.05 | 985.53 | 657.35 |
| SP349357 | Ac-LTF$r8EF4coohWAQCba$AAAAAa-NH2 | iso2 | 1969.04 | 986.06 | 1970.05 | 985.53 | 657.35 |
| SP350358 | Ac-LTF$r8EYWSQCba$AAAAAa-NH2 | | 1957.04 | 980.04 | 1958.05 | 979.53 | 653.35 |
| SP351359 | Ac-LTF$r8EYWSQCba$AAAAAa-NH2 | iso2 | 1957.04 | 980.04 | 1958.05 | 979.53 | 653.35 |
| SP352360 | Ac-LTF$r8EYWAQCba$SAAa-NH2 | | 1814.96 | 909 | 1815.97 | 908.49 | 605.99 |
| SP353361 | Ac-LTF$r8EYWAQCba$SAAa-NH2 | iso2 | 1814.96 | 909 | 1815.97 | 908.49 | 605.99 |
| SP354362 | Ac-ALTF$r8EYWAQCba$SAAa-NH2 | | 1886 | 944.52 | 1887.01 | 944.01 | 629.67 |
| SP355363 | Ac-ALTF$r8EYWAQCba$SAAa-NH2 | iso2 | 1886 | 944.98 | 1887.01 | 944.01 | 629.67 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP356 | 364 Ac-ALTF$r8EYWAQCba$SAAAa-NH2 | | 1957.04 | 980.04 | 1958.05 | 979.53 | 653.35 |
| SP357 | 365 Ac-ALTF$r8EYWAQCba$SAAAa-NH2 | iso2 | 1957.04 | 980.04 | 1958.05 | 979.53 | 653.35 |
| SP358 | 366 Ac-AALTF$r8EYWAQCba$SAAAa-NH2 | | 2028.07 | 1016.1 | 2029.08 | 1015.04 | 677.03 |
| SP359 | 367 Ac-AALTF$r8EYWAQCba$SAAAa-NH2 | iso2 | 2028.07 | 1015.57 | 2029.08 | 1015.04 | 677.03 |
| SP360 | 368 Ac-RTF$r8EYWAQCba$SAA-NH2 | | 1786.94 | 895.03 | 1787.95 | 894.48 | 596.65 |
| SP361 | 369 Ac-LRF$r8EYWAQCba$SAA-NH2 | | 1798.98 | 901.51 | 1799.99 | 900.5 | 600.67 |
| SP362 | 370 Ac-LTF$r8EYWRQCba$SAA-NH2 | | 1828.99 | 916.4 | 1830 | 915.5 | 610.67 |
| SP363 | 371 Ac-LTF$r8EYWARCba$SAA-NH2 | | 1771.97 | 887.63 | 1772.98 | 886.99 | 591.66 |
| SP364 | 372 Ac-LTF$r8EYWAQCba$RAA-NH2 | | 1812.99 | 908.08 | 1814 | 907.5 | 605.34 |
| SP365 | 373 Ac-LTF$r8EYWAQCba$SRA-NH2 | | 1828.99 | 916.12 | 1830 | 915.5 | 610.67 |
| SP366 | 374 Ac-LTF$r8EYWAQCba$SAR-NH2 | | 1828.99 | 916.12 | 1830 | 915.5 | 610.67 |
| SP367 | 375 5-FAM-BaLTF$r8EYWAQCba$SAA-NH2 | | 2131 | 1067.09 | 2132.01 | 1066.51 | 711.34 |
| SP368 | 376 5-FAM-BaLTF$r8AYWAQL$AAN1eA-NH2 | | 2158.08 | 1080.6 | 2159.09 | 1080.05 | 720.37 |
| SP369 | 377 Ac-LAF$r8EYWAQL$AAN1eA-NH2 | | 1799 | 901.05 | 1800.01 | 900.51 | 600.67 |
| SP370 | 378 Ac-ATF$r8EYWAQL$AAN1eA-NH2 | | 1786.97 | 895.03 | 1787.98 | 894.49 | 596.66 |
| SP371 | 379 Ac-AAF$r8EYWAQL$AAN1eA-NH2 | | 1756.96 | 880.05 | 1757.97 | 879.49 | 586.66 |
| SP372 | 380 Ac-AAAF$r8EYWAQL$AAN1eA-NH2 | | 1827.99 | 915.57 | 1829 | 915 | 610.34 |
| SP373 | 381 Ac-AAAAF$r8EYWAQL$AAN1eA-NH2 | | 1899.03 | 951.09 | 1900.04 | 950.52 | 634.02 |
| SP374 | 382 Ac-AATF$r8EYWAQL$AAN1eA-NH2 | | 1858 | 930.92 | 1859.01 | 930.01 | 620.34 |
| SP375 | 383 Ac-AALTF$r8EYWAQL$AAN1eA-NH2 | | 1971.09 | 987.17 | 1972.1 | 986.55 | 658.04 |
| SP376 | 384 Ac-AAALTF$r8EYWAQL$AAN1eA-NH2 | | 2042.12 | 1023.15 | 2043.13 | 1022.07 | 681.71 |
| SP377 | 385 Ac-LTF$r8EYWAQL$AAN1eAA-NH2 | | 1900.05 | 952.02 | 1901.06 | 951.03 | 634.36 |
| SP378 | 386 Ac-ALTF$r8EYWAQL$AAN1eAA-NH2 | | 1971.09 | 987.63 | 1972.1 | 986.55 | 658.04 |
| SP379 | 387 Ac-AALTF$r8EYWAQL$AAN1eAA-NH2 | | 2042.12 | 1022.69 | 2043.13 | 1022.07 | 681.71 |
| SP380 | 388 Ac-LTF$r8EYWAQCba$AAN1eAA-NH2 | | 1912.05 | 958.03 | 1913.06 | 957.03 | 638.36 |
| SP381 | 389 Ac-LTF$r8EYWAQhL$AAN1eAA-NH2 | | 1914.07 | 958.68 | 1915.08 | 958.04 | 639.03 |
| SP382 | 390 Ac-ALTF$r8EYWAQhL$AAN1eAA-NH2 | | 1985.1 | 994.1 | 1986.11 | 993.56 | 662.71 |
| SP383 | 391 Ac-LTF$r8ANmYWAQL$AAN1eA-NH2 | | 1785.02 | 894.11 | 1786.03 | 893.52 | 596.01 |
| SP384 | 392 Ac-LTF$r8ANmYWAQL$AAN1eA-NH2 | iso2 | 1785.02 | 894.11 | 1786.03 | 893.52 | 596.01 |
| SP385 | 393 Ac-LTF$r8AYNmWAQL$AAN1eA-NH2 | | 1785.02 | 894.11 | 1786.03 | 893.52 | 596.01 |
| SP386 | 394 Ac-LTF$r8AYNmWAQL$AAN1eA-NH2 | iso2 | 1785.02 | 894.11 | 1786.03 | 893.52 | 596.01 |
| SP387 | 395 Ac-LTF$r8AYAmwQL$AAN1eA-NH2 | | 1785.02 | 894.01 | 1786.03 | 893.52 | 596.01 |
| SP388 | 396 Ac-LTF$r8AYAmwQL$AAN1eA-NH2 | iso2 | 1785.02 | 894.01 | 1786.03 | 893.52 | 596.01 |
| SP389 | 397 Ac-LTF$r8AYWAibQL$AAN1eA-NH2 | | 1785.02 | 894.01 | 1786.03 | 893.52 | 596.01 |
| SP390 | 398 Ac-LTF$r8AYWAibQL$AAN1eA-NH2 | iso2 | 1785.02 | 894.01 | 1786.03 | 893.52 | 596.01 |
| SP391 | 399 Ac-LTF$r8AYWAQL$AAibN1eA-NH2 | | 1785.02 | 894.38 | 1786.03 | 893.52 | 596.01 |
| SP392 | 400 Ac-LTF$r8AYWAQL$AAibN1eA-NH2 | iso2 | 1785.02 | 894.38 | 1786.03 | 893.52 | 596.01 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP393 | 401 Ac-LTF$r8AYWAQL$AaNleA-NH2 | | 1771.01 | 887.54 | 1772.02 | 886.51 | 591.34 |
| SP394 | 402 Ac-LTF$r8AYWAQL$AaNleA-NH2 | iso2 | 1771.01 | 887.54 | 1772.02 | 886.51 | 591.34 |
| SP395 | 403 Ac-LTF$r8AYWAQL$ASarNleA-NH2 | | 1771.01 | 887.35 | 1772.02 | 886.51 | 591.34 |
| SP396 | 404 Ac-LTF$r8AYWAQL$ASarNleA-NH2 | iso2 | 1771.01 | 887.35 | 1772.02 | 886.51 | 591.34 |
| SP397 | 405 Ac-LTF$r8AYWAQL$AANleAib-NH2 | | 1785.02 | 894.75 | 1786.03 | 893.52 | 596.01 |
| SP398 | 406 Ac-LTF$r8AYWAQL$AANleAib-NH2 | iso2 | 1785.02 | 894.75 | 1786.03 | 893.52 | 596.01 |
| SP399 | 407 Ac-LTF$r8AYWAQL$AANleNmA-NH2 | | 1785.02 | 894.6 | 1786.03 | 893.52 | 596.01 |
| SP400 | 408 Ac-LTF$r8AYWAQL$AANleNmA-NH2 | iso2 | 1785.02 | 894.6 | 1786.03 | 893.52 | 596.01 |
| SP401 | 409 Ac-LTF$r8AYWAQL$AANleSar-NH2 | | 1771.01 | 886.98 | 1772.02 | 886.51 | 591.34 |
| SP402 | 410 Ac-LTF$r8AYWAQL$AANleSar-NH2 | iso2 | 1771.01 | 886.98 | 1772.02 | 886.51 | 591.34 |
| SP403 | 411 Ac-LTF$r8AYWAQL$AANleAAib-NH2 | | 1856.06 | | 1857.07 | 929.04 | 619.69 |
| SP404 | 412 Ac-LTF$r8AYWAQL$AANleAAib-NH2 | iso2 | 1856.06 | | 1857.07 | 929.04 | 619.69 |
| SP405 | 413 Ac-LTF$r8AYWAQL$AANleANmA-NH2 | | 1856.06 | 930.37 | 1857.07 | 929.04 | 619.69 |
| SP406 | 414 Ac-LTF$r8AYWAQL$AANleANmA-NH2 | iso2 | 1856.06 | 930.37 | 1857.07 | 929.04 | 619.69 |
| SP407 | 415 Ac-LTF$r8AYWAQL$AANleAa-NH2 | | 1842.04 | 922.69 | 1843.05 | 922.03 | 615.02 |
| SP408 | 416 Ac-LTF$r8AYWAQL$AANleAa-NH2 | iso2 | 1842.04 | 922.69 | 1843.05 | 922.03 | 615.02 |
| SP409 | 417 Ac-LTF$r8AYWAQL$AANleASar-NH2 | | 1842.04 | 922.6 | 1843.05 | 922.03 | 615.02 |
| SP410 | 418 Ac-LTF$r8AYWAQL$AANleASar-NH2 | iso2 | 1842.04 | 922.6 | 1843.05 | 922.03 | 615.02 |
| SP411 | 419 Ac-LTF$/r8AYWAQL$/AANleA-NH2 | | 1799.04 | 901.14 | 1800.05 | 900.53 | 600.69 |
| SP412 | 420 Ac-LTFAibAYWAQLAibAANleA-NH2 | | 1648.9 | 826.02 | 1649.91 | 825.46 | 550.64 |
| SP413 | 421 Ac-LTF$r8Cou4YWAQL$AANleA-NH2 | | 1975.05 | 989.11 | 1976.06 | 988.53 | 659.36 |
| SP414 | 422 Ac-LTF$r8Cou4YWAQL$AANleA-NH2 | iso2 | 1975.05 | 989.11 | 1976.06 | 988.53 | 659.36 |
| SP415 | 423 Ac-LTF$r8AYWCou4QL$AANleA-NH2 | | 1975.05 | 989.11 | 1976.06 | 988.53 | 659.36 |
| SP416 | 424 Ac-LTF$r8AYWAQL$Cou4ANleA-NH2 | | 1975.05 | 989.57 | 1976.06 | 988.53 | 659.36 |
| SP417 | 425 Ac-LTF$r8AYWAQL$Cou4ANleA-NH2 | iso2 | 1975.05 | 989.57 | 1976.06 | 988.53 | 659.36 |
| SP418 | 426 Ac-LTF$r8AYWAQL$ACou4NleA-NH2 | | 1975.05 | 989.57 | 1976.06 | 988.53 | 659.36 |
| SP419 | 427 Ac-LTF$r8AYWAQL$ACou4NleA-NH2 | iso2 | 1975.05 | 989.57 | 1976.06 | 988.53 | 659.36 |
| SP420 | 428 Ac-LTF$r8AYWAQL$AANleA-OH | | 1771.99 | 887.63 | 1773 | 887 | 591.67 |
| SP421 | 429 Ac-LTF$r8AYWAQL$AANleA-OH | iso2 | 1771.99 | 887.63 | 1773 | 887 | 591.67 |
| SP422 | 430 Ac-LTF$r8AYWAQL$AANleA-NHnPr | | 1813.05 | 908.08 | 1814.06 | 907.53 | 605.36 |
| SP423 | 431 Ac-LTF$r8AYWAQL$AANleA-NHnPr | iso2 | 1813.05 | 908.08 | 1814.06 | 907.53 | 605.36 |
| SP424 | 432 Ac-LTF$r8AYWAQL$AANleA-NHnBu33Me | | 1855.1 | 929.17 | 1856.11 | 928.56 | 619.37 |
| SP425 | 433 Ac-LTF$r8AYWAQL$AANleA-NHnBu33Me | iso2 | 1855.1 | 929.17 | 1856.11 | 928.56 | 619.37 |
| SP426 | 434 Ac-LTF$r8AYWAQL$AANleA-NHHex | | 1855.1 | 929.17 | 1856.11 | 928.56 | 619.37 |
| SP427 | 435 Ac-LTF$r8AYWAQL$AANleA-NHHex | iso2 | 1855.1 | 929.17 | 1856.11 | 928.56 | 619.37 |
| SP428 | 436 Ac-LTA$r8AYWAQL$AANleA-NH2 | | 1694.98 | 849.33 | 1695.99 | 848.5 | 566 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP429437 | Ac-LThL$r8AYWAQL$AANleA-NH2 | | 1751.04 | 877.09 | 1752.05 | 876.53 | 584.69 |
| SP430438 | Ac-LTF$r8AYAAQL$AANleA-NH2 | | 1655.97 | 829.54 | 1656.98 | 828.99 | 553 |
| SP431439 | Ac-LTF$r8AY2NalAQL$AANleA-NH2 | | 1782.01 | 892.63 | 1783.02 | 892.01 | 595.01 |
| SP432440 | Ac-LTF$r8EYWCou4QCba$SAA-NH2 | | 1947.97 | 975.8 | 1948.98 | 974.99 | 650.33 |
| SP433441 | Ac-LTF$r8EYWCou7QCba$SAA-NH2 | | 16.03 | 974.9 | 17.04 | 9.02 | 6.35 |
| SP434442 | Ac-LTF%r8EYWAQCba%SAA-NH2 | | 1745.94 | 874.8 | 1746.95 | 873.98 | 582.99 |
| SP435443 | Dmaac-LTF$r8EYWAQCba$SAA-NH2 | | 1786.97 | 894.8 | 1787.98 | 894.49 | 596.66 |
| SP436444 | Dmaac-LTF$r8AYWAQL$AAAAa-NH2 | | 1914.08 | 958.2 | 1915.09 | 958.05 | 639.03 |
| SP437445 | Dmaac-LTF$r8AYWAQL$AAAAa-NH2 | iso2 | 1914.08 | 958.2 | 1915.09 | 958.05 | 639.03 |
| SP438446 | Dmaac-LTF$r8AYWAQL$AAAAa-NH2 | | 1972.08 | 987.3 | 1973.09 | 987.05 | 658.37 |
| SP439447 | Dmaac-LTF$r8AYWAQL$AAAAa-NH2 | iso2 | 1972.08 | 987.3 | 1973.09 | 987.05 | 658.37 |
| SP440448 | Dmaac-LTF$r8EF4coohWAQCba$AAIa-NH2 | | 1912.05 | 957.4 | 1913.06 | 957.03 | 638.36 |
| SP441449 | Dmaac-LTF$r8EF4coohWAQCba$AAIa-NH2 | iso2 | 1912.05 | 957.4 | 1913.06 | 957.03 | 638.36 |
| SP442450 | Dmaac-LTF$r8AYWAQL$AANleA-NH2 | | 1814.05 | 908.3 | 1815.06 | 908.03 | 605.69 |
| SP443451 | Dmaac-LTF$r8AYWAQL$AANleA-NH2 | iso2 | 1814.05 | 908.3 | 1815.06 | 908.03 | 605.69 |
| SP444452 | Ac-LTF%r8AYWAQL%AANleA-NH2 | | 1773.02 | 888.37 | 1774.03 | 887.52 | 592.01 |
| SP445453 | Ac-LTF%r8EYWAQL%AAAAa-NH2 | | 1931.06 | 966.4 | 1932.07 | 966.54 | 644.69 |
| SP446454 | Cou6BaLTF$r8EYWAQhL$SAA-NH2 | | 2018.05 | 1009.9 | 2019.06 | 1010.03 | 673.69 |
| SP447455 | Cou8BaLTF$r8EYWAQhL$SAA-NH2 | | 1962.96 | 982.34 | 1963.97 | 982.49 | 655.32 |
| SP448456 | Ac-LTF4I$r8EYWAQL$AAAAa-NH2 | | 2054.93 | 1028.68 | 2055.94 | 1028.47 | 685.98 |
| SP449457 | Ac-LTF$r8EYWAQL$AAAAa-NH2 | | 1929.04 | 966.17 | 1930.05 | 965.53 | 644.02 |
| SP550458 | Ac-LTF$r8EYWAQL$AAAAa-OH | | 1930.02 | 966.54 | 1931.03 | 966.02 | 644.35 |
| SP551459 | Ac-LTF$r8EYWAQL$AAAAa-OH | iso2 | 1930.02 | 965.89 | 1931.03 | 966.02 | 644.35 |
| SP552460 | Ac-LTF$r8EYWAEL$AAAAa-NH2 | | 1930.02 | 966.82 | 1931.03 | 966.02 | 644.35 |
| SP553461 | Ac-LTF$r8EYWAEL$AAAAa-NH2 | iso2 | 1930.02 | 966.91 | 1931.03 | 966.02 | 644.35 |
| SP554462 | Ac-LTF$r8EYWAEL$AAAAa-OH | | 1931.01 | 967.28 | 1932.02 | 966.51 | 644.68 |
| SP555463 | Ac-LTF$r8EY6clWAQL$AAAAa-NH2 | | 1963 | 983.28 | 1964.01 | 982.51 | 655.34 |
| SP556464 | Ac-LTF$r8EF4bOH2WAQL$AAAAa-NH2 | | 1957.05 | 980.04 | 1958.06 | 979.53 | 653.36 |
| SP557465 | Ac-AAALTF$r8EYWAQL$AAAAa-NH2 | | 2142.15 | 1072.83 | 2143.16 | 1072.08 | 715.06 |
| SP558466 | Ac-LTF34F2$r8EYWAQL$AAAAa-NH2 | | 1965.02 | 984.3 | 1966.03 | 983.52 | 656.01 |
| SP559467 | Ac-RTF$r8EYWAQL$AAAAa-NH2 | | 1972.06 | 987.81 | 1973.07 | 987.04 | 658.36 |
| SP560468 | Ac-LTA$r8EYWAQL$AAAAa-NH2 | | 1853.01 | 928.33 | 1854.02 | 927.51 | 618.68 |
| SP561469 | Ac-LTF$r8EYWAibQL$AAAAa-NH2 | | 1943.06 | 973.48 | 1944.07 | 972.54 | 648.69 |
| SP562470 | Ac-LTF$r8EYWAQL$AAibAAAa-NH2 | | 1943.06 | 973.11 | 1944.07 | 972.54 | 648.69 |
| SP563471 | Ac-LTF$r8EYWAQL$AAAibAAa-NH2 | | 1943.06 | 973.48 | 1944.07 | 972.54 | 648.69 |
| SP564472 | Ac-LTF$r8EYWAQL$AAAAibAa-NH2 | | 1943.06 | 973.48 | 1944.07 | 972.54 | 648.69 |
| SP565473 | Ac-LTF$r8EYWAQL$AAAAAiba-NH2 | | 1943.06 | 973.38 | 1944.07 | 972.54 | 648.69 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP566474 | Ac-LTF$r8EYWAQL$AAAAAiba-NH2 | iso2 | 1943.06 | 973.38 | 1944.07 | 972.54 | 648.69 |
| SP567475 | Ac-LTF$r8EYWAQL$AAAAAib-NH2 | | 1943.06 | 973.01 | 1944.07 | 972.54 | 648.69 |
| SP568476 | Ac-LTF$r8EYWAQL$AaAAAa-NH2 | | 1929.04 | 966.54 | 1930.05 | 965.53 | 644.02 |
| SP569477 | Ac-LTF$r8EYWAQL$AAaAAa-NH2 | | 1929.04 | 966.35 | 1930.05 | 965.53 | 644.02 |
| SP570478 | Ac-LTF$r8EYWAQL$AAAaAa-NH2 | | 1929.04 | 966.54 | 1930.05 | 965.53 | 644.02 |
| SP571479 | Ac-LTF$r8EYWAQL$AAAaAa-NH2 | iso2 | 1929.04 | 966.35 | 1930.05 | 965.53 | 644.02 |
| SP572480 | Ac-LTF$r8EYWAQL$AAAAaa-NH2 | | 1929.04 | 966.35 | 1930.05 | 965.53 | 644.02 |
| SP573481 | Ac-LTF$r8EYWAQL$AAAAAA-NH2 | | 1929.04 | 966.35 | 1930.05 | 965.53 | 644.02 |
| SP574482 | Ac-LTF$r8EYWAQL$ASarAAAa-NH2 | | 1929.04 | 966.54 | 1930.05 | 965.53 | 644.02 |
| SP575483 | Ac-LTF$r8EYWAQL$AASarAAa-NH2 | | 1929.04 | 966.35 | 1930.05 | 965.53 | 644.02 |
| SP576484 | Ac-LTF$r8EYWAQL$AAASarAa-NH2 | | 1929.04 | 966.35 | 1930.05 | 965.53 | 644.02 |
| SP577485 | Ac-LTF$r8EYWAQL$AAAASara-NH2 | | 1929.04 | 966.35 | 1930.05 | 965.53 | 644.02 |
| SP578486 | Ac-LTF$r8EYWAQL$AAAAASar-NH2 | | 1929.04 | 966.08 | 1930.05 | 965.53 | 644.02 |
| SP579487 | Ac-7LTF$r8EYWAQL$AAAAAa-NH2 | | 1918.07 | 951.99 | 1919.08 | 960.04 | 640.37 |
| SP581488 | Ac-TF$r8EYWAQL$AAAAAa-NH2 | | 1815.96 | 929.85 | 1816.97 | 908.99 | 606.33 |
| SP582489 | Ac-F$r8EYWAQL$AAAAAa-NH2 | | 1714.91 | 930.92 | 1715.92 | 858.46 | 572.64 |
| SP583490 | Ac-LVF$r8EYWAQL$AAAAAa-NH2 | | 1927.06 | 895.12 | 1928.07 | 964.54 | 643.36 |
| SP584491 | Ac-AAF$r8EYWAQL$AAAAAa-NH2 | | 1856.98 | 859.51 | 1857.99 | 929.5 | 620 |
| SP585492 | Ac-LTF$r8EYWAQL$AAAAa-NH2 | | 1858 | 824.08 | 1859.01 | 930.01 | 620.34 |
| SP586493 | Ac-LTF$r8EYWAQL$AAAa-NH2 | | 1786.97 | 788.56 | 1787.98 | 894.49 | 596.66 |
| SP587494 | Ac-LTF$r8EYWAQL$AAa-NH2 | | 1715.93 | 1138.57 | 1716.94 | 858.97 | 572.98 |
| SP588495 | Ac-LTF$r8EYWAQL$Aa-NH2 | | 1644.89 | 1144.98 | 1645.9 | 823.45 | 549.3 |
| SP589496 | Ac-LTF$r8EYWAQL$a-NH2 | | 1573.85 | 1113.71 | 1574.86 | 787.93 | 525.62 |
| SP590497 | Ac-LTF$r8EYWAQL$AAA-OH | | 1716.91 | 859.55 | 1717.92 | 859.46 | 573.31 |
| SP591498 | Ac-LTF$r8EYWAQL$A-OH | | 1574.84 | 975.14 | 1575.85 | 788.43 | 525.95 |
| SP592499 | Ac-LTF$r8EYWAQL$AAA-NH2 | | 1715.93 | 904.75 | 1716.94 | 858.97 | 572.98 |
| SP593500 | Ac-LTF$r8EYWAQCba$SAA-OH | | 1744.91 | 802.49 | 1745.92 | 873.46 | 582.64 |
| SP594501 | Ac-LTF$r8EYWAQCba$S-OH | | 1602.83 | 913.53 | 1603.84 | 802.42 | 535.28 |
| SP595502 | Ac-LTF$r8EYWAQCba$S-NH2 | | 1601.85 | 979.58 | 1602.86 | 801.93 | 534.96 |
| SP596503 | 4-FBzl-LTF$r8EYWAQL$AAAAAa-NH2 | | 2009.05 | 970.52 | 2010.06 | 1005.53 | 670.69 |
| SP597504 | 4-FBzl-LTF$r8EYWAQCba$SAA-NH2 | | 1823.93 | 965.8 | 1824.94 | 912.97 | 608.98 |
| SP598505 | Ac-LTF$r8RYWAQL$AAAAAa-NH2 | | 1956.1 | 988.28 | 1957.11 | 979.06 | 653.04 |
| SP599506 | Ac-LTF$r8HYWAQL$AAAAAa-NH2 | | 1937.06 | 1003.54 | 1938.07 | 969.54 | 646.69 |
| SP600507 | Ac-LTF$r8QYWAQL$AAAAAa-NH2 | | 1928.06 | 993.92 | 1929.07 | 965.04 | 643.69 |
| SP601508 | Ac-LTF$r8CitYWAQL$AAAAAa-NH2 | | 1957.08 | 987 | 1958.09 | 979.55 | 653.37 |
| SP602509 | Ac-LTF$r8GlaYWAQL$AAAAAa-NH2 | | 1973.03 | 983 | 1974.04 | 987.52 | 658.68 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP603 | 510 Ac-LTF$r8F4gYWAQL$AAAAAa-NH2 | | 2004.1 | 937.86 | 2005.11 | 1003.06 | 669.04 |
| SP604 | 511 Ac-LTF$r82mRYWAQL$AAAAAa-NH2 | | 1984.13 | 958.58 | 1985.14 | 993.07 | 662.38 |
| SP605 | 512 Ac-LTF$r8ipKYWAQL$AAAAAa-NH2 | | 1970.14 | 944.52 | 1971.15 | 986.08 | 657.72 |
| SP606 | 513 Ac-LTF$r8F4NH2YWAQL$AAAAAa-NH2 | | 1962.08 | 946 | 1963.09 | 982.05 | 655.03 |
| SP607 | 514 Ac-LTF$r8EYWAAL$AAAAAa-NH2 | | 1872.02 | 959.32 | 1873.03 | 937.02 | 625.01 |
| SP608 | 515 Ac-LTF$r8EYWALL$AAAAAa-NH2 | | 1914.07 | 980.88 | 1915.08 | 958.04 | 639.03 |
| SP609 | 516 Ac-LTF$r8EYWAAibL$AAAAAa-NH2 | | 1886.03 | 970.61 | 1887.04 | 944.02 | 629.68 |
| SP610 | 517 Ac-LTF$r8EYWASL$AAAAAa-NH2 | | 1888.01 | 980.51 | 1889.02 | 945.01 | 630.34 |
| SP611 | 518 Ac-LTF$r8EYWANL$AAAAAa-NH2 | | 1915.02 | 1006.41 | 1916.03 | 958.52 | 639.35 |
| SP612 | 519 Ac-LTF$r8EYWACitL$AAAAAa-NH2 | | 1958.07 | | 1959.08 | 980.04 | 653.7 |
| SP613 | 520 Ac-LTF$r8EYWAHL$AAAAAa-NH2 | | 1938.04 | 966.24 | 1939.05 | 970.03 | 647.02 |
| SP614 | 521 Ac-LTF$r8EYWARL$AAAAAa-NH2 | | 1957.08 | | 1958.09 | 979.55 | 653.37 |
| SP615 | 522 Ac-LTF$r8EpYWAQL$AAAAAa-NH2 | | 2009.01 | | 2010.02 | 1005.51 | 670.68 |
| SP616 | 523 Cbm-LTF$r8EYWAQCba$SAA-NH2 | | 1590.85 | | 1591.86 | 796.43 | 531.29 |
| SP617 | 524 Cbm-LTF$r8EYWAQL$AAAAAa-NH2 | | 1930.04 | | 1931.05 | 966.03 | 644.35 |
| SP618 | 525 Ac-LTF$r8EYWAQL$SAAAAa-NH2 | | 1945.04 | 1005.11 | 1946.05 | 973.53 | 649.35 |
| SP619 | 526 Ac-LTF$r8EYWAQL$AAAASa-NH2 | | 1945.04 | 986.52 | 1946.05 | 973.53 | 649.35 |
| SP620 | 527 Ac-LTF$r8EYWAQL$SAAASa-NH2 | | 1961.03 | 993.27 | 1962.04 | 981.52 | 654.68 |
| SP621 | 528 Ac-LTF$r8EYWAQTba$AAAAAa-NH2 | | 1943.06 | 983.1 | 1944.07 | 972.54 | 648.69 |
| SP622 | 529 Ac-LTF$r8EYWAQAdm$AAAAAa-NH2 | | 2007.09 | 990.31 | 2008.1 | 1004.55 | 670.04 |
| SP623 | 530 Ac-LTF$r8EYWAQCha$AAAAAa-NH2 | | 1969.07 | 987.17 | 1970.08 | 985.54 | 657.36 |
| SP624 | 531 Ac-LTF$r8EYWAQhCha$AAAAAa-NH2 | | 1983.09 | 1026.11 | 1984.1 | 992.55 | 662.04 |
| SP625 | 532 Ac-LTF$r8EYWAQF$AAAAAa-NH2 | | 1963.02 | 957.01 | 1964.03 | 982.52 | 655.35 |
| SP626 | 533 Ac-LTF$r8EYWAQhF$AAAAAa-NH2 | | 1977.04 | 1087.81 | 1978.05 | 989.53 | 660.02 |
| SP627 | 534 Ac-LTF$r8EYWAQL$AANleAAa-NH2 | | 1971.09 | 933.45 | 1972.1 | 986.55 | 658.04 |
| SP628 | 535 Ac-LTF$r8EYWAQAdm$AANleAAa-NH2 | | 2049.13 | 1017.97 | 2050.14 | 1025.57 | 684.05 |
| SP629 | 536 4-FBz-BaLTF$r8EYWAQL$AAAAAa-NH2 | | 2080.08 | | 2081.09 | 1041.05 | 694.37 |
| SP630 | 537 4-FBz-BaLTF$r8EYWAQCba$SAA-NH2 | | 1894.97 | | 1895.98 | 948.49 | 632.66 |
| SP631 | 538 Ac-LTF$r5EYWAQL$s8AAAAAa-NH2 | | 1929.04 | 1072.68 | 1930.05 | 965.53 | 644.02 |
| SP632 | 539 Ac-LTF$r5EYWAQCba$s8SAA-NH2 | | 1743.92 | 1107.79 | 1744.93 | 872.97 | 582.31 |
| SP633 | 540 Ac-LTF$r8EYWAQL$AAhhLAAa-NH2 | | 1999.12 | | 2000.13 | 1000.57 | 667.38 |
| SP634 | 541 Ac-LTF$r8EYWAQL$AAAAAAa-NH2 | | 2071.11 | | 2072.12 | 1036.56 | 691.38 |
| SP635 | 542 Ac-LTF$r8EYWAQL$AAAAAAAa-NH2 | | 2142.15 | 778.1 | 2143.16 | 1072.08 | 715.06 |
| SP636 | 543 Ac-LTF$r8EYWAQL$AAAAAAAAa-NH2 | | 2213.19 | 870.53 | 2214.2 | 1107.6 | 738.74 |
| SP637 | 544 Ac-LTA$r8EYAAQCba$SAA-NH2 | | 1552.85 | | 1553.86 | 777.43 | 518.62 |
| SP638 | 545 Ac-LTA$r8EYAAQL$AAAAAa-NH2 | | 1737.97 | 779.45 | 1738.98 | 869.99 | 580.33 |
| SP639 | 546 Ac-LTF$r8EPmpWAQL$AAAAAa-NH2 | | 2007.03 | 779.54 | 2008.04 | 1004.52 | 670.02 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP640 | 547 Ac-LTF$r8EPmpWAQCba$SAA-NH2 | | 1821.91 | 838.04 | 1822.92 | 911.96 | 608.31 |
| SP641 | 548 Ac-ATF$r8HYWAQL$S-NH2 | | 1555.82 | 867.83 | 1556.83 | 778.92 | 519.61 |
| SP642 | 549 Ac-LTF$r8HAWAQL$S-NH2 | | 1505.84 | 877.91 | 1506.85 | 753.93 | 502.95 |
| SP643 | 550 Ac-LTF$r8HYWAQA$S-NH2 | | 1555.82 | 852.52 | 1556.83 | 778.92 | 519.61 |
| SP644 | 551 Ac-LTF$r8EYWAQCba$SA-NH2 | | 1672.89 | 887.18 | 1673.9 | 837.45 | 558.64 |
| SP645 | 552 Ac-LTF$r8EYWAQL$SAA-NH2 | | 1731.92 | 873.32 | 1732.93 | 866.97 | 578.31 |
| SP646 | 553 Ac-LTF$r8HYWAQCba$SAA-NH2 | | 1751.94 | 873.05 | 1752.95 | 876.98 | 584.99 |
| SP647 | 554 Ac-LTF$r8SYWAQCba$SAA-NH2 | | 1701.91 | 844.88 | 1702.92 | 851.96 | 568.31 |
| SP648 | 555 Ac-LTF$r8RYWAQCba$SAA-NH2 | | 1770.98 | 865.58 | 1771.99 | 886.5 | 591.33 |
| SP649 | 556 Ac-LTF$r8KYWAQCba$SAA-NH2 | | 1742.98 | 936.57 | 1743.99 | 872.5 | 582 |
| SP650 | 557 Ac-LTF$r8QYWAQCba$SAA-NH2 | | 1742.94 | 930.93 | 1743.95 | 872.48 | 581.99 |
| SP651 | 558 Ac-LTF$r8EYWAACba$SAA-NH2 | | 1686.9 | 1032.45 | 1687.91 | 844.46 | 563.31 |
| SP652 | 559 Ac-LTF$r8EYWAQCba$AAA-NH2 | | 1727.93 | 895.46 | 1728.94 | 864.97 | 576.98 |
| SP653 | 560 Ac-LTF$r8EYWAQL$AAAAA-OH | | 1858.99 | 824.54 | 1860 | 930.5 | 620.67 |
| SP654 | 561 Ac-LTF$r8EYWAQL$AAAA-OH | | 1787.95 | 894.48 | 1788.96 | 894.98 | 596.99 |
| SP655 | 562 Ac-LTF$r8EYWAQL$AA-OH | | 1645.88 | 856 | 1646.89 | 823.95 | 549.63 |
| SP656 | 563 Ac-LTF$r8AF4bOH2WAQL$AAAAAa-NH2 | | | | | | |
| SP657 | 564 Ac-LTF$r8AF4bOH2WAAL$AAAAAa-NH2 | | | | | | |
| SP658 | 565 Ac-LTF$r8EF4bOH2WAQCba$SAA-NH2 | | | | | | |
| SP659 | 566 Ac-LTF$r8ApYWAQL$AAAAAa-NH2 | | | | | | |
| SP660 | 567 Ac-LTF$r8ApYWAAL$AAAAAa-NH2 | | | | | | |
| SP661 | 568 Ac-LTF$r8EpYWAQCba$SAA-NH2 | | | | | | |
| SP662 | 569 Ac-LTF$rda6AYWAQL$da5AAAAAa-NH2 | | 1974.06 | 934.44 | | | |
| SP663 | 570 Ac-LTF$rda6EYWAQCba$da5SAA-NH2 | | 1846.95 | 870.52 | | 869.94 | |
| SP664 | 571 Ac-LTF$rda6EYWAQL$da5AAAAAa-NH2 | | | | | | |
| SP665 | 572 Ac-LTF$ra9EYWAQL$a6AAAAAa-NH2 | | | 936.57 | | 935.51 | |
| SP666 | 573 Ac-LTF$ra9EYWAQL$a6AAAAAa-NH2 | | | | | | |
| SP667 | 574 Ac-LTF$ra9EYWAQCba$a6SAA-NH2 | | | | | | |
| SP668 | 575 Ac-LTA$ra9EYWAQCba$a6SAA-NH2 | | | | | | |
| SP669 | 576 5-FAM-BaLTF$ra9EYWAQCba$a6SAA-NH2 | | | | | | |
| SP670 | 577 5-FAM-BaLTF$r8EYWAQL$AAAAAa-NH2 | | 2316.11 | | | | |
| SP671 | 578 5-FAM-BaLTF$/r8EYWAQL$/AAAAAa-NH2 | | 2344.15 | | | | |
| SP672 | 579 5-FAM-BaLTA$r8EYWAQL$AAAAAa-NH2 | | 2240.08 | | | | |
| SP673 | 580 5-FAM-BaLTF$r8AYWAQL$AAAAAa-NH2 | | 2258.11 | | | | |
| SP674 | 581 5-FAM-BaATF$r8EYWAQL$AAAAAa-NH2 | | 2274.07 | | | | |
| SP675 | 582 5-FAM-BaLAF$r8EYWAQL$AAAAAa-NH2 | | 2286.1 | | | | |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP676 | 583 5-FAM-BaLTF$r8EAWAQL$AAAAAa-NH2 | | 2224.09 | | | | |
| SP677 | 584 5-FAM-BaLTF$r8EYAAQL$AAAAAa-NH2 | | 2201.07 | | | | |
| SP678 | 585 5-FAM-BaLTA$r8EYAAQL$AAAAAa-NH2 | | 2125.04 | | | | |
| SP679 | 586 5-FAM-BaLTF$r8EYWAAL$AAAAAa-NH2 | | 2259.09 | | | | |
| SP680 | 587 5-FAM-BaLTF$r8EYWAQA$AAAAAa-NH2 | | 2274.07 | | | | |
| SP681 | 588 5-FAM-BaLTF$/r8EYWAQCba$/SAA-NH2 | | 2159.03 | | | | |
| SP682 | 589 5-FAM-BaLTASr8EYWAQCba$SAA-NH2 | | 2054.97 | | | | |
| SP683 | 590 5-FAM-BaLTF$r8EYAAQCba$SAA-NH2 | | 2015.96 | | | | |
| SP684 | 591 5-FAM-BaLTA$r8EYAAQCba$SAA-NH2 | | 1939.92 | | | | |
| SP685 | 592 5-FAM-BaQSQQTF$r8NLWRLL$QN-NH2 | | 2495.23 | | | | |
| SP686 | 593 5-TAMRA-BaLTF$r8EYWAQCba$SAA-NH2 | | 2186.1 | | | | |
| SP687 | 594 5-TAMRA-BaLTA$r8EYWAQCba$SAA-NH2 | | 2110.07 | | | | |
| SP688 | 595 5-TAMRA-BaLTF$r8EYAAQCba$SAA-NH2 | | 2071.06 | | | | |
| SP689 | 596 5-TAMRA-BaLTA$r8EYAAQCba$SAA-NH2 | | 1995.03 | | | | |
| SP690 | 597 5-TAMRA-BaLTF$/r8EYWAQCba$/SAA-NH2 | | 2214.13 | | | | |
| SP691 | 598 5-TAMRA-BaLTF$r8EYWAQL$AAAAAa-NH2 | | 2371.22 | | | | |
| SP692 | 599 5-TAMRA-BaLTA$r8EYWAQL$AAAAAa-NH2 | | 2295.19 | | | | |
| SP693 | 600 5-TAMRA-BaLTF$/r8EYWAQL$/AAAAAa-NH2 | | 2399.25 | | | | |
| SP694 | 601 Ac-LTF$r8EYWCou7QCba$SAA-OH | | 1947.93 | | | | |
| SP695 | 602 Ac-LTF$r8EYWCou7QCba$S-OH | | 1805.86 | | | | |
| SP696 | 603 Ac-LTA$r8EYWCou7QCba$SAA-NH2 | | 1870.91 | | | | |
| SP697 | 604 Ac-LTF$r8EYACou7QCba$SAA-NH2 | | 1831.9 | | | | |
| SP698 | 605 Ac-LTA$r8EYACou7QCba$SAA-NH2 | | 1755.87 | | | | |
| SP699 | 606 Ac-LTF$/r8EYWCou7QCba$/SAA-NH2 | | 1974.98 | | | | |
| SP700 | 607 Ac-LTF$r8EYWCou7QL$AAAAAa-NH2 | | 2132.06 | | | | |
| SP701 | 608 Ac-LTF$/r8EYWCou7QL$/AAAAAa-NH2 | | 2160.09 | | | | |
| SP702 | 609 Ac-LTF$r8EYWCou7QL$AAAAA-OH | | 2062.01 | | | | |
| SP703 | 610 Ac-LTF$r8EYWCou7QL$AAAA-OH | | 1990.97 | | | | |
| SP704 | 611 Ac-LTF$r8EYWCou7QL$AAA-OH | | 1919.94 | | | | |
| SP705 | 612 Ac-LTFSr8EYWCou7QL$AA-OH | | 1848.9 | | | | |
| SP706 | 613 Ac-LTFSr8EYWCou7QL$A-OH | | 1777.86 | | | | |
| SP707 | 614 Ac-LTF$r8EYWAQL$AAAASa-NH2 | iso2 | | 974.4 | | 973.53 | |
| SP708 | 615 Ac-LTF$r8AYWAAL$AAAAAa-NH2 | iso2 | 1814.01 | 908.82 | 1815.02 | 908.01 | 605.68 |
| SP709 | 616 Biotin-BaLTF$r8EYWAQL$AAAAAa-NH2 | | 2184.14 | 1093.64 | 2185.15 | 1093.08 | 729.05 |
| SP710 | 617 Ac-LTF$r8HAWAQL$S-NH2 | iso2 | 1505.84 | 754.43 | 1506.85 | 753.93 | 502.95 |
| SP711 | 618 Ac-LTF$r8EYWAQCba$SA-NH2 | iso2 | 1672.89 | 838.05 | 1673.9 | 837.45 | 558.64 |
| SP712 | 619 Ac-LTF$r8HYWAQCba$SAA-NH2 | iso2 | 1751.94 | 877.55 | 1752.95 | 876.98 | 584.99 |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP713620 | Ac-LTF$r8SYWAQCba$SAA-NH2 | iso2 | 1701.91 | 852.48 | 1702.92 | 851.96 | 568.31 |
| SP714621 | Ac-LTF$r8RYWAQCba$SAA-NH2 | iso2 | 1770.98 | 887.45 | 1771.99 | 886.5 | 591.33 |
| SP715622 | Ac-LTF$r8KYWAQCba$SAA-NH2 | iso2 | 1742.98 | 872.92 | 1743.99 | 872.5 | 582 |
| SP716623 | Ac-LTF$r8EYWAQCba$AAA-NH2 | iso2 | 1727.93 | 865.71 | 1728.94 | 864.97 | 576.98 |
| SP717624 | Ac-LTF$r8EYWAQL$AAAAAaBaC-NH2 | | 2103.09 | 1053.12 | 2104.1 | 1052.55 | 702.04 |
| SP718625 | Ac-LTF$r8EYWAQL$AAAAAadPeg4C-NH2 | | 2279.19 | 1141.46 | 2280.2 | 1140.6 | 760.74 |
| SP719626 | Ac-LTA$r8AYWAAL$AAAAAa-NH2 | | 1737.98 | 870.43 | 1738.99 | 870 | 580.33 |
| SP720627 | Ac-LTF$r8AYAAAL$AAAAAa-NH2 | | 1698.97 | 851 | 1699.98 | 850.49 | 567.33 |
| SP721628 | 5-FAM-BaLTF$r8AYWAAL$AAAAAa-NH2 | | 2201.09 | 1101.87 | 2202.1 | 1101.55 | 734.7 |
| SP722629 | Ac-LTA$r8AYWAQL$AAAAAa-NH2 | | 1795 | 898.92 | 1796.01 | 898.51 | 599.34 |
| SP723630 | Ac-LTF$r8AYAAQL$AAAAAa-NH2 | | 1755.99 | 879.49 | 1757 | 879 | 586.34 |
| SP724631 | Ac-LTF$rda6AYWAAL$da5AAAAAa-NH2 | | 1807.97 | | 1808.98 | 904.99 | 603.66 |
| SP725632 | FITC-BaLTF$r8EYWAQL$AAAAAa-NH2 | | 2347.1 | 1174.49 | 2348.11 | 1174.56 | 783.37 |
| SP726633 | FITC-BaLTF$r8EYWAQCba$SAA-NH2 | | 2161.99 | 1082.35 | 2163 | 1082 | 721.67 |
| SP733634 | Ac-LTF$r8EYWAQL$EAAAAa-NH2 | | 1987.05 | 995.03 | 1988.06 | 994.53 | 663.36 |
| SP734635 | Ac-LTF$r8AYWAQL$EAAAAa-NH2 | | 1929.04 | 966.35 | 1930.05 | 965.53 | 644.02 |
| SP735636 | Ac-LTF$r8EYWAQL$AAAAAaBaKbio-NH2 | | 2354.25 | 1178.47 | 2355.26 | 1178.13 | 785.76 |
| SP736637 | Ac-LTF$r8AYWAAL$AAAAAa-NH2 | | 1814.01 | 908.45 | 1815.02 | 908.01 | 605.68 |
| SP737638 | Ac-LTF$r8AYAAAL$AAAAAa-NH2 | iso2 | 1698.97 | 850.91 | 1699.98 | 850.49 | 567.33 |
| SP738639 | Ac-LTF$r8AYAAQL$AAAAAa-NH2 | iso2 | 1755.99 | 879.4 | 1757 | 879 | 586.34 |
| SP739640 | Ac-LTF$r8EYWAQL$EAAAAa-NH2 | iso2 | 1987.05 | 995.21 | 1988.06 | 994.53 | 663.36 |
| SP740641 | Ac-LTF$r8AYWAQL$EAAAAa-NH2 | iso2 | 1929.04 | 966.08 | 1930.05 | 965.53 | 644.02 |
| SP741642 | Ac-LTF$r8EYWAQCba$SAAAAa-NH2 | | 1957.04 | 980.04 | 1958.05 | 979.53 | 653.35 |
| SP742643 | Ac-LTF$r8EYWAQLStAAA$r5AA-NH2 | | 2023.12 | 1012.83 | 2024.13 | 1012.57 | 675.38 |
| SP743644 | Ac-LTF$r8EYWAQL$A$AAA$A-NH2 | | 2108.17 | 1055.44 | 2109.18 | 1055.09 | 703.73 |
| SP744645 | Ac-LTF$r8EYWAQL$AA$AAA$A-NH2 | | 2179.21 | 1090.77 | 2180.22 | 1090.61 | 727.41 |
| SP745646 | Ac-LTF$r8EYWAQL$AAA$AAA$A-NH2 | | 2250.25 | 1126.69 | 2251.26 | 1126.13 | 751.09 |
| SP746647 | Ac-AAALTF$r8EYWAQL$AAA-OH | | 1930.02 | | 1931.03 | 966.02 | 644.35 |
| SP747648 | Ac-AAALTF$r8EYWAQL$AAA-NH2 | | 1929.04 | 965.85 | 1930.05 | 965.53 | 644.02 |
| SP748649 | Ac-AAAALTF$r8EYWAQL$AAA-NH2 | | 2000.08 | 1001.4 | 2001.09 | 1001.05 | 667.7 |
| SP749650 | Ac-AAAAALTF$r8EYWAQL$AAA-NH2 | | 2071.11 | 1037.13 | 2072.12 | 1036.56 | 691.38 |
| SP750651 | Ac-AAAAAALTF$r8EYWAQL$AAA-NH2 | | 2142.15 | | 2143.16 | 1072.08 | 715.06 |
| SP751652 | Ac-LTF$rda6EYWAQCba$da6SAA-NH2 | iso2 | 1751.89 | 877.36 | 1752.9 | 876.95 | 584.97 |
| SP752653 | Ac-t$r5a$r5f4CF3ekllr-NH2 | | | 844.25 | | | |
| SP753654 | Ac-tawy$r5nf4CF3eSr5llr-NH2 | | | 837.03 | | | |
| SP754655 | Ac-tawya$r5f4CF3ek$r5lr-NH2 | | | 822.97 | | | |

TABLE 1-continued

List of peptidomimetic macrocycles derived from the MDM2/MDMX-binding helix of p53 that were prepared.

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP755 656 | Ac-tawyanf4CF3e$r5llr$r5a-NH2 | | | 908.35 | | | |
| SP756 657 | Ac-t$s8anf4CF3e$r5llr-NH2 | | | 858.03 | | | |
| SP757 658 | Ac-tawy$s8nf4CF3ekll$r5a-NH2 | | | 879.86 | | | |
| SP758 659 | Ac-tawya$s8f4CF3ekllr$r5a-NH2 | | | 936.38 | | | |
| SP759 660 | Ac-tawy$s8naekll$r5a-NH2 | | | 844.25 | | | |
| SP760 661 | 5-FAM-Batawy$s8nf4CF3ekll$r5a-NH2 | | | | | | |
| SP761 662 | 5-FAM-Batawy$s8naekll$r5a-NH2 | | | | | | |
| SP762 663 | Ac-tawy$s8nf4CF3eall$r5a-NH2 | | | | | | |
| SP763 664 | Ac-tawy$s8nf4CF3ekll$r5aaaaa-NH2 | | | | | | |
| SP764 665 | Ac-tawy$s8nf4CF3eall$r5aaaaa-NH2 | | | | | | |

Table 1a shows a selection of peptidomimetic macrocycles.

TABLE 1a

| SP | SEQ ID NO: Sequence | Isomer | Exact Mass | Found Mass | Calc (M + 1)/1 | Calc (M + 2)/2 | Calc (M + 3)/3 |
|---|---|---|---|---|---|---|---|
| SP244 666 | Ac-LTF$r8EF4coohWAQCba$SAN1eA-NH2 | | 1885 | 943.59 | 1886.01 | 943.51 | 629.34 |
| SP331 667 | Ac-LTF$r8EYWAQL$AAAAAa-NH2 | iso2 | 1929.04 | 966.08 | 1930.05 | 965.53 | 644.02 |
| SP555 668 | Ac-LTF$r8EY6clWAQL$AAAAAa-NH2 | | 1963 | 983.28 | 1964.01 | 982.51 | 655.34 |
| SP557 669 | Ac-AAALTF$r8EYWAQL$AAAAAa-NH2 | | 2142.15 | 1072.83 | 2143.16 | 1072.08 | 715.06 |
| SP558 670 | Ac-LTF34F2$r8EYWAQL$AAAAAa-NH2 | | 1965.02 | 984.3 | 1966.03 | 983.52 | 656.01 |
| SP562 671 | Ac-LTF$r8EYWAQL$AAibAAAa-NH2 | | 1943.06 | 973.11 | 1944.07 | 972.54 | 648.69 |
| SP564 672 | Ac-LTF$r8EYWAQL$AAAAibAa-NH2 | | 1943.06 | 973.48 | 1944.07 | 972.54 | 648.69 |
| SP566 673 | Ac-LTF$r8EYWAQL$AAAAAiba-NH2 | iso2 | 1943.06 | 973.38 | 1944.07 | 972.54 | 648.69 |
| SP567 674 | Ac-LTF$r8EYWAQL$AAAAAAib-NH2 | | 1943.06 | 973.01 | 1944.07 | 972.54 | 648.69 |
| SP572 675 | Ac-LTF$r8EYWAQL$AAAAaa-NH2 | | 1929.04 | 966.35 | 1930.05 | 965.53 | 644.02 |
| SP573 676 | Ac-LTF$r8EYWAQL$AAAAAA-NH2 | | 1929.04 | 966.35 | 1930.05 | 965.53 | 644.02 |
| SP578 677 | Ac-LTF$r8EYWAQL$AAAAASar-NH2 | | 1929.04 | 966.08 | 1930.05 | 965.53 | 644.02 |
| SP551 678 | Ac-LTF$r8EYWAQL$AAAAAa-OH | iso2 | 1930.02 | 965.89 | 1931.03 | 966.02 | 644.35 |
| SP662 679 | Ac-LTF$rda6AYWAQL$da5AAAAAa-NH2 | | 1974.06 | 934.44 | | 933.49 | |
| SP367 680 | 5-FAM-BaLTF$r8EYWAQCba$SAA-NH2 | | 2131 | 1067.09 | 2132.01 | 1066.51 | 711.34 |
| SP349 681 | Ac-LTF$r8EF4coohWAQCba$AAAAAa-NH2 | iso2 | 1969.04 | 986.06 | 1970.05 | 985.53 | 657.35 |
| SP347 682 | Ac-LTF$r8EYWAQCba$AAAAAa-NH2 | iso2 | 1941.04 | 972.55 | 1942.05 | 971.53 | 648.02 |

Table 1b shows a further selection of peptidomimetic macrocycles.

TABLE 1b

| SP | SEQ ID NO: | Sequence | Isomer | Exact Mass | Found Mass | Calc (M + 1)/1 | Calc (M + 2)/2 | Calc (M + 3)/3 |
|---|---|---|---|---|---|---|---|---|
| SP581 | 683 | Ac-TF$r8EYWAQL$AAAAAa-NH2 | | 1815.96 | 929.85 | 1816.97 | 908.99 | 606.33 |
| SP582 | 684 | Ac-F$r8EYWAQL$AAAAAa-NH2 | | 1714.91 | 930.92 | 1715.92 | 858.46 | 572.64 |
| SP583 | 685 | Ac-LVF$r8EYWAQL$AAAAAa-NH2 | | 1927.06 | 895.12 | 1928.07 | 964.54 | 643.36 |
| SP584 | 686 | Ac-AAF$r8EYWAQL$AAAAAa-NH2 | | 1856.98 | 859.51 | 1857.99 | 929.5 | 620 |
| SP585 | 687 | Ac-LTF$r8EYWAQL$AAAAAa-NH2 | | 1858 | 824.08 | 1859.01 | 930.01 | 620.34 |
| SP586 | 688 | Ac-LTF$r8EYWAQL$AAAa-NH2 | | 1786.97 | 788.56 | 1787.98 | 894.49 | 596.66 |
| SP587 | 689 | Ac-LTF$r8EYWAQL$AAa-NH2 | | 1715.93 | 1138.57 | 1716.94 | 858.97 | 572.98 |
| SP588 | 690 | Ac-LTF$r8EYWAQL$Aa-NH2 | | 1644.89 | 1144.98 | 1645.9 | 823.45 | 549.3 |
| SP589 | 691 | Ac-LTF$r8EYWAQL$a-NH2 | | 1573.85 | 1113.71 | 1574.86 | 787.93 | 525.62 |
| SP590 | 692 | Ac-LTF$r8AYWAQL$A-NH$_2$ | | | 758.97 | | 758.93 | |

TABLE 1d

Selected peptidomimetic macrocycles derived from the MDM2/MDMX-binding helix of p53.

| SP# | L | RT* | Ala (%) | IC$_{50}$ MDM2 (nM) | SJSA-1 EC$_{50}$ (μM)** | Solubility (mg/mL) |
|---|---|---|---|---|---|---|
| 590 | 12 | 74.2 | 25 | 140.7 | 6 | ≤1 |
| 68 | 15 | 91.5 | 33 | 29.02 | 1.12 | 3 |
| 315 | 17 | ≥100 | 47 | 30.77 | 0.18 | 4.5 |
| 317 | 18 | ≥100 | 50 | 10 | 0.1 | 5 |

*Normalized and calculated according to Example 11 (see table and equation).
**10% serum, 72 hr
L = length in amino acids;
RT = retention time;
Ala = alanine content TABLE 1f Selected peptidomimetic macrocycles that inhibit the MDM2/MDMX and p53 interaction.

| SP# | Ch | L | VH | RT (min)* | Ala % | Ki MDM2 (nM) | SJSA-1 EC$_{50}$ (μM)** |
|---|---|---|---|---|---|---|---|
| 778 | 1 | 12 | 9.8 | 5.53 | 17 | 19251.34 | >30 |
| 779 | 1 | 12 | 9.8 | 6.52 | 17 | 48.16 | ND |
| 757 | 0 | 13 | 6.3 | 7.99 | 15 | 2.92 | 1.5 |
| 763 | 0 | 17 | 6.7 | 8.74 | 35 | 10.9 | 0.34 |

*See Example 11 table
**10% serum, 72 hr
Ch = net charge;
L = length in amino acids;
VH = von Heijne;
RT = retention time;
Ala = alanine content TABLE 1e Peptidomimetic macrocycles that inhibit the MDM2/MDMX and p53 interaction.

| SP# | SEQ ID NO: | Sequence | Calc. (M + 2)/2 | Found Mass |
|---|---|---|---|---|
| 778 | 693 | Ac-tawyanfekllr-NH$_2$ | 776.92 | 777.46 |
| 779 | 694 | Ac-tawyanf4CF3ekllr-NH$_2$ | 810.91 | 811.41 |
| 752 | 695 | Ac-t$r5wya$r5f4CF3ekllr-NH$_2$ | | 844.25 |
| 753 | 696 | Ac-tawy$r5nf4CF3e$r5llr-NH$_2$ | | 837.03 |
| 754 | 697 | Ac-tawya$r5f4CF3ek$r5lr-NH$_2$ | | 822.97 |
| 755 | 698 | Ac-tawyanf4CF3e$r5llr$r5a-NH$_2$ | | 908.35 |
| 756 | 699 | Ac-t$s8anf4CF3e$r5llr-NH$_2$ | | 858.03 |
| 757 | 700 | Ac-tawy$s8nf4CF3ekll$r5a-NH$_2$ | 878.97 | 879.86 |
| 758 | 701 | Ac-tawya$s8f4CF3ekllr$r5a-NH$_2$ | | 936.38 |
| 763 | 702 | Ac-tawy$s8nf4CF3ekl$r5aaaaa-NH$_2$ | | |

In some embodiments, the invention provides a peptidomimetic macrocycle that comprises an amino acid sequence that has at least 60%, 70%, 80%, 90%, 95%, 97%, or 100% identity to any one of the amino acid sequences in Table 1, 1a, 1b, 1c, 1e or 1f.

In the sequences shown above and elsewhere, the following abbreviations are used: "Nle" represents norleucine, "Aib" represents 2-aminoisobutyric acid, "Ac" represents acetyl, and "Pr" represents propionyl. Amino acids represented as "$" are alpha-Me S5-pentenyl-alanine olefin amino acids connected by an all-carbon crosslinker comprising one double bond. Amino acids represented as "$r5" are alpha-Me $R_5$-pentenyl-alanine olefin amino acids connected by an all-carbon comprising one double bond. Amino acids represented as "$s8" are alpha-Me S8-octenyl-alanine olefin amino acids connected by an all-carbon crosslinker comprising one double bond. Amino acids represented as "$r8" are alpha-Me R8-octenyl-alanine olefin amino acids connected by an all-carbon crosslinker comprising one double bond. "Ahx" represents an aminocyclohexyl linker. The crosslinkers are linear all-carbon crosslinker comprising eight or eleven carbon atoms between the alpha carbons of each amino acid. Amino acids represented as "$/" are alpha-Me S5-pentenyl-alanine olefin amino acids that are not connected by any crosslinker. Amino acids represented as "$/r5" are alpha-Me $R_5$-pentenyl-alanine olefin amino acids that are not connected by any crosslinker. Amino acids represented as "$/s8" are alpha-Me S8-octenyl-alanine olefin amino acids that are not connected by any crosslinker. Amino acids represented as "$/r8" are alpha-Me R8-octenyl-alanine olefin amino acids that are not connected by any crosslinker. Amino acids represented as "Amw" are alpha-Me tryptophan amino acids. Amino acids represented as "Aml" are alpha-Me leucine amino acids. Amino acids represented as "Amf" are alpha-Me phenylalanine amino acids. Amino acids represented as "2ff" are 2-fluoro-phenylalanine amino acids. Amino acids represented as "3ff" are 3-fluoro-phenylalanine amino acids. Amino acids represented as "St" are amino acids comprising two pentenyl-alanine olefin side chains, each of which is crosslinked to another amino acid as indicated. Amino acids represented as "St//" are amino acids comprising two pentenyl-alanine olefin side chains that are not crosslinked. Amino acids represented as "% St" are amino acids comprising two pentenyl-alanine olefin side chains, each of which is crosslinked to another amino acid as indicated via fully saturated hydrocarbon crosslinks. Amino acids represented as "Ba" are beta-alanine. The lower-case character "e" or "z" within the designation of a crosslinked amino acid (e.g. "$er8" or "$zr8") represents the configuration of the double bond (E or Z, respectively). In other contexts, lower-case letters such as "a" or "f" represent D amino acids (e.g. D-alanine, or D-phenylalanine, respectively). Amino acids designated as "NmW" represent N-methyltryptophan. Amino acids designated as "NmY" represent N-methyltyrosine. Amino acids designated as "NmA" represent N-methylalanine. "Kbio" represents a biotin group attached to the side chain amino group of a lysine residue. Amino acids designated as "Sar" represent sarcosine. Amino acids designated as "Cha" represent cyclohexyl alanine. Amino acids designated as "Cpg" represent cyclopentyl glycine. Amino acids designated as "Chg" represent cyclohexyl glycine. Amino acids designated as "Cba" represent cyclobutyl alanine. Amino acids designated as "F4I" represent 4-iodo phenylalanine. "7L" represents N15 isotopic leucine. Amino acids designated as "F3Cl" represent 3-chloro phenylalanine. Amino acids designated as "F4cooh" represent 4-carboxy phenylalanine. Amino acids designated as "F34F2" represent 3,4-difluoro phenylalanine. Amino acids designated as "6clW" represent 6-chloro tryptophan. Amino acids designated as "$rda6" represent alpha-Me R6-hexynyl-alanine alkynyl amino acids, crosslinked via a dialkyne bond to a second alkynyl amino acid. Amino acids designated as "$da5" represent alpha-Me S5-pentynyl-alanine alkynyl amino acids, wherein the alkyne forms one half of a dialkyne bond with a second alkynyl amino acid. Amino acids designated as "$ra9" represent alpha-Me $R_9$-nonynyl-alanine alkynyl amino acids, crosslinked via an alkyne metathesis reaction with a second alkynyl amino acid. Amino acids designated as "$a6" represent alpha-Me S6-hexynyl-alanine alkynyl amino acids, crosslinked via an alkyne metathesis reaction with a second alkynyl amino acid. The designation "iso1" or "iso2" indicates that the peptidomimetic macrocycle is a single isomer.

Amino acids designated as "Cit" represent citrulline. Amino acids designated as "Cou4", "Cou6", "Cou7" and "Cou8", respectively, represent the following structures:

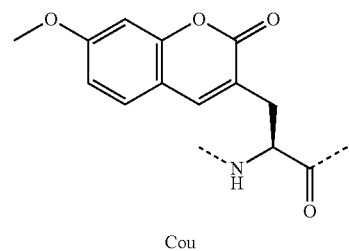

Cou

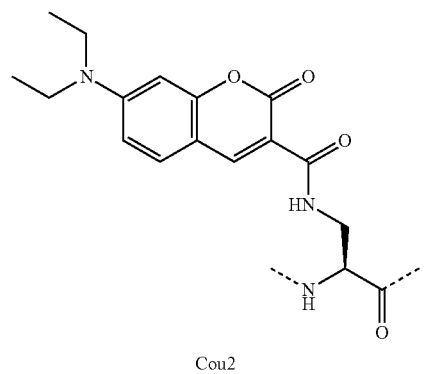

Cou2

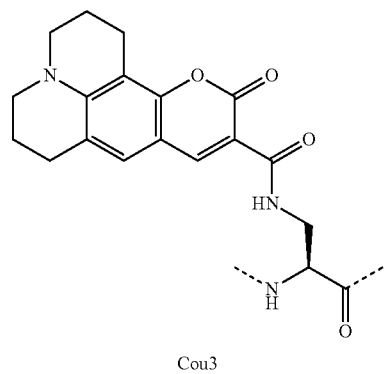

Cou3

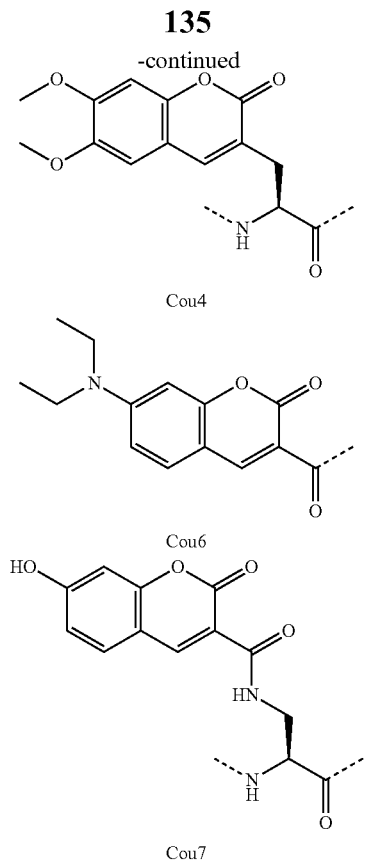

In some embodiments, a peptidomimetic macrocycle is obtained in more than one isomer, for example due to the configuration of a double bond within the structure of the crosslink (E vs Z). Such isomers can or cannot be separable by conventional chromatographic methods. In some embodiments, one isomer has improved biological properties relative to the other isomer. In one embodiment, an E crosslink olefin isomer of a peptidomimetic macrocycle has better solubility, better target affinity, better in vivo or in vitro efficacy, higher helicity, or improved cell permeability relative to its Z counterpart. In another embodiment, a Z crosslink olefin isomer of a peptidomimetic macrocycle has better solubility, better target affinity, better in vivo or in vitro efficacy, higher helicity, or improved cell permeability relative to its E counterpart.

Table 1c shows exemplary peptidomimetic macrocycle:

TABLE 1c

Structure

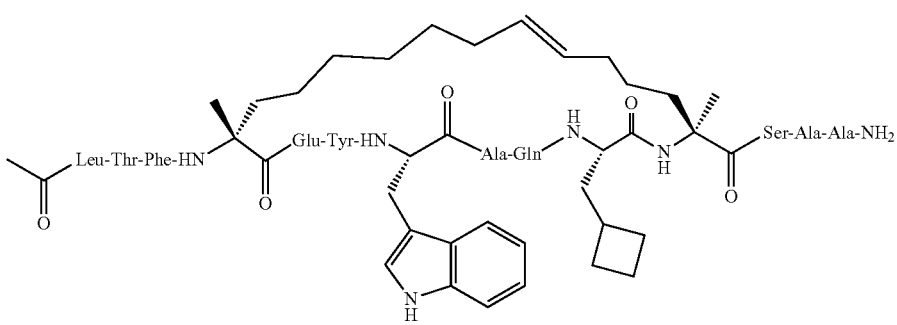

Ac-L T F $er8 EYWAQCba $e SAA-NH2

Chemical Formula: $C_{87}H_{125}N_{17}O_{21}$
Exact Mass: 1743.92
Molecular Weight: 1745.02

TABLE 1c-continued
Structure
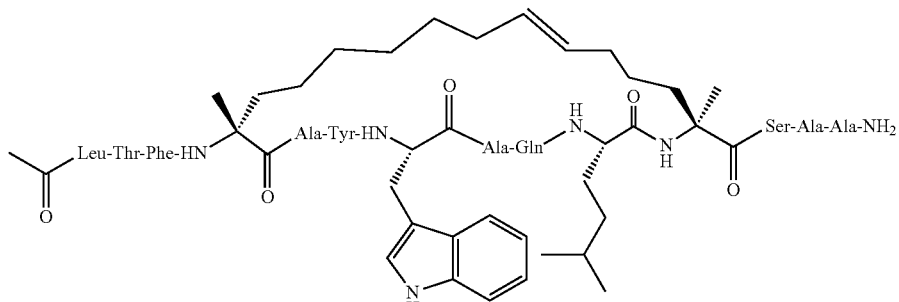
Ac-L T F $er8 AYWAQhL $e SAA-NH2
Chemical Formula: $C_{85}H_{125}N_{17}O_{19}$
Exact Mass: 1687.93
Molecular Weight: 1689.00
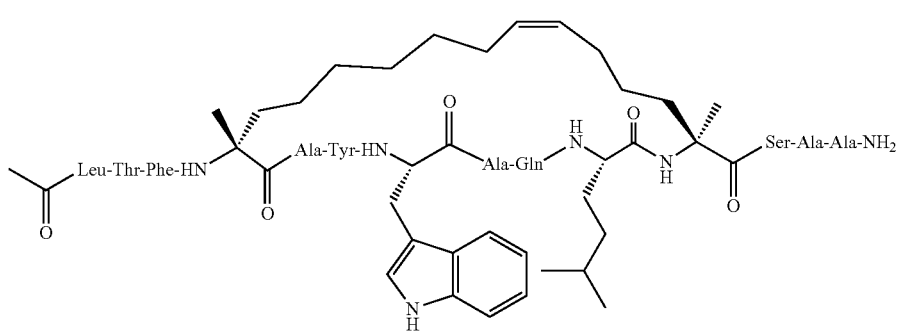
Ac-L T F $zr8 AYWAQhL $z SAA-NH2
Chemical Formula: $C_{85}H_{125}N_{17}O_{19}$
Exact Mass: 1687.93
Molecular Weight: 1689.00
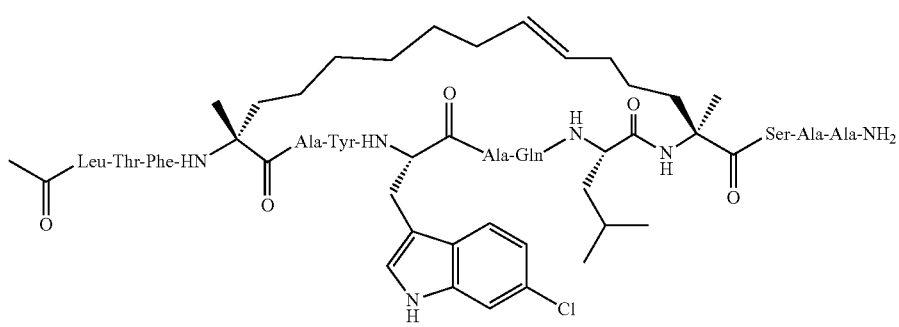
Ac-L T F $er8 AY6clWAQL $e SAA-NH2
Chemical Formula: $C_{84}H_{122}ClN_{17}O_{19}$
Exact Mass: 1707.88
Molecular Weight: 1709.42

TABLE 1c-continued
Structure
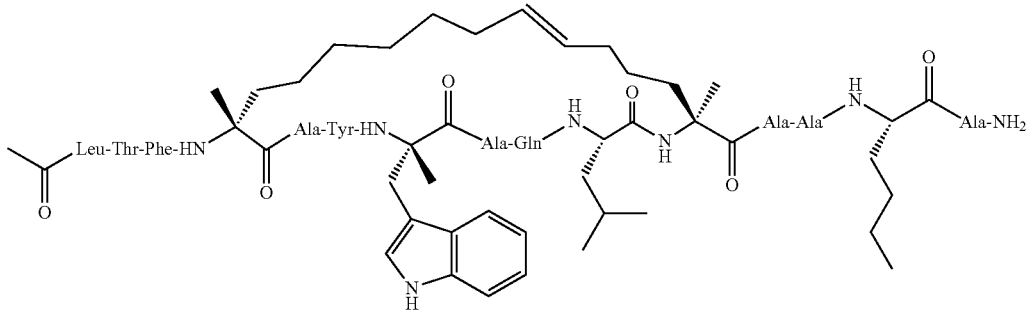
Ac-L T F $er8 AYAmwAQL $e AA Nle A-NH2
Chemical Formula: $C_{91}H_{136}N_{18}O_{19}$
Exact Mass: 1785.02
Molecular Weight: 1786.16
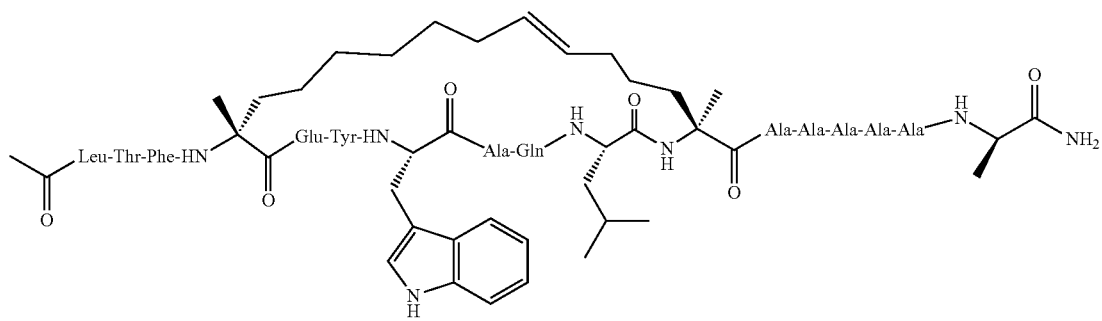
Ac-L T F $er8 EYWAQL $e AAAAA a-NH2
Chemical Formula: $C_{95}H_{140}N_{20}O_{23}$
Exact Mass: 1929.04
Molecular Weight: 1930.25
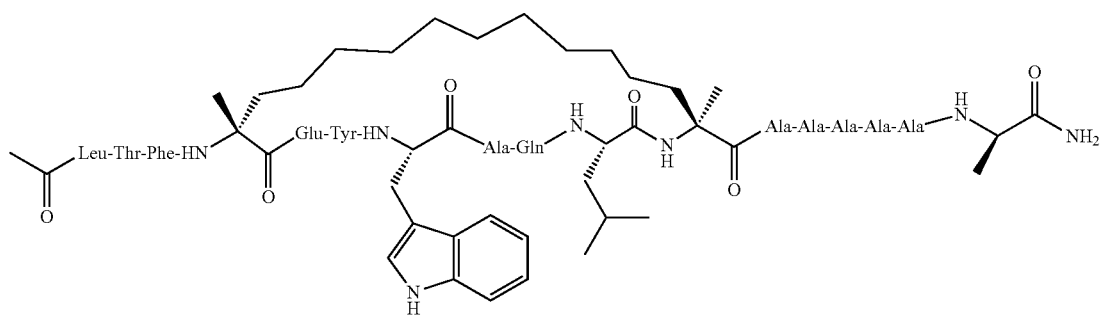
Ac-L T F %r8 EYWAQL % AAAAA a-NH2
Chemical Formula: $C_{95}H_{142}N_{20}O_{23}$
Exact Mass: 1931.06
Molecular Weight: 1932.26

TABLE 1c-continued
Structure
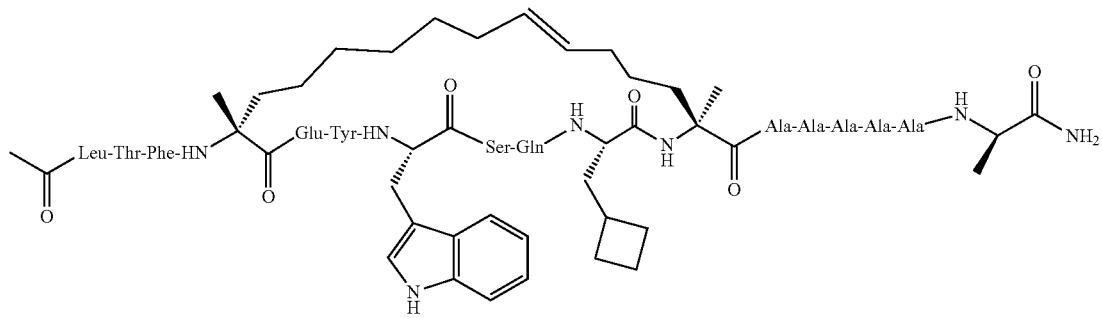
Ac-L T F $ser8 EYWSQCba $e AAAAA a-NH2
Chemical Formula: $C_{96}H_{140}N_{20}O_{24}$
Exact Mass: 1957.03
Molecular Weight: 1958.26
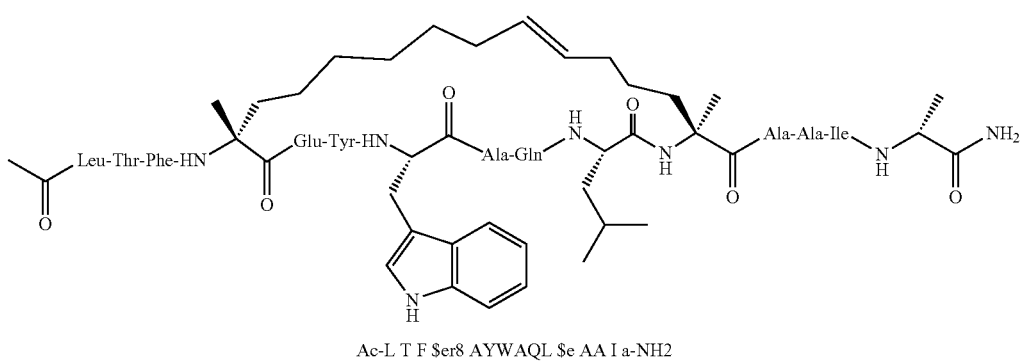
Ac-L T F $ser8 AYWAQL $e AA I a-NH2
Chemical Formula: $C_{90}H_{134}N_{18}O_{19}$
Exact Mass: 1771.01
Molecular Weight: 1772.14
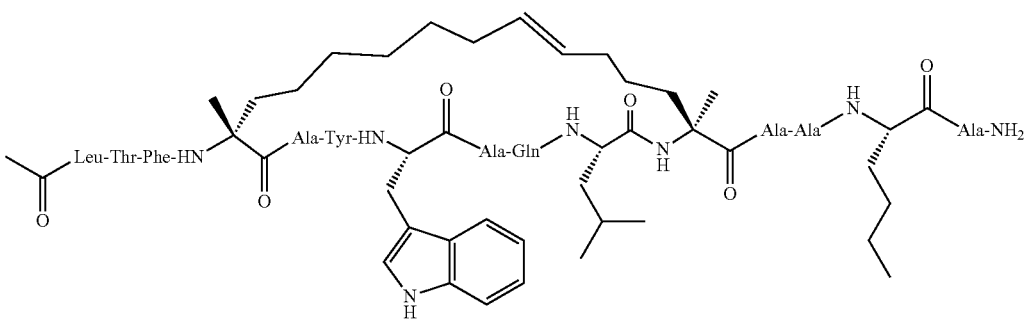
Ac-L T F $ser8 AYWAQL $eAA Nle A-NH2
Chemical Formula: $C_{90}H_{134}N_{18}O_{19}$
Exact Mass: 1771.01
Molecular Weight: 1772.14

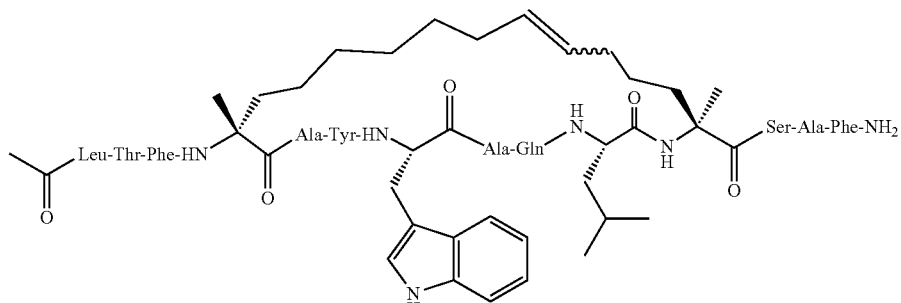
Ac-L T F $r8 AYWAQL $ SA F-NH2
Chemical Formula: $C_{90}H_{127}N_{17}O_{19}$
Exact Mass: 1749.95
Molecular Weight: 1751.07
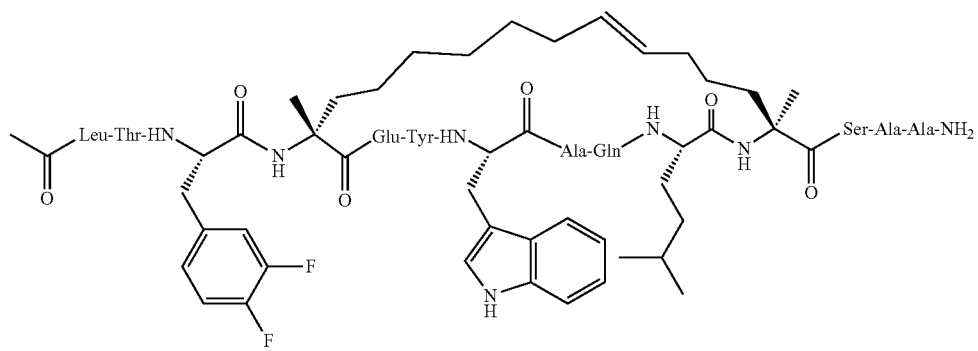
Ac-L T F34F2 $er8 EYWAQhL $e SAA-NH2
Chemical Formula: $C_{87}H_{125}F_2N_{17}O_{21}$
Exact Mass: 1781.92
Molecular Weight: 1783.02
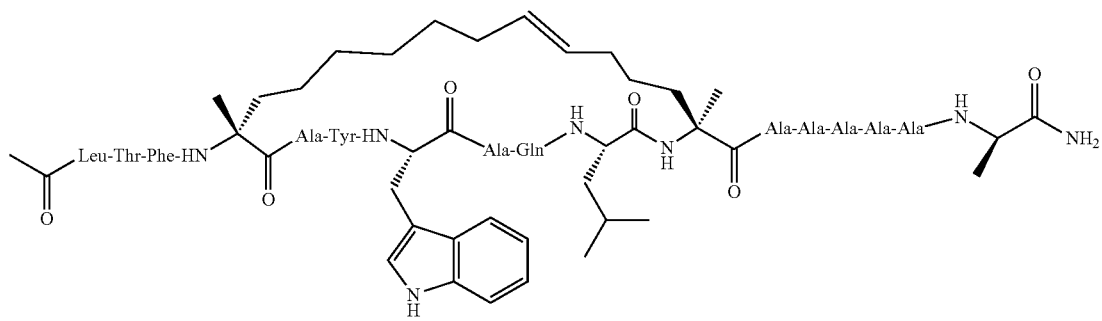
Ac-L T F $er8 AYWAQL $e AAAAA a-NH2
Chemical Formula: $C_{93}H_{138}N_{20}O_{21}$
Exact Mass: 1871.03
Molecular Weight: 1872.21

TABLE 1c-continued
Structure
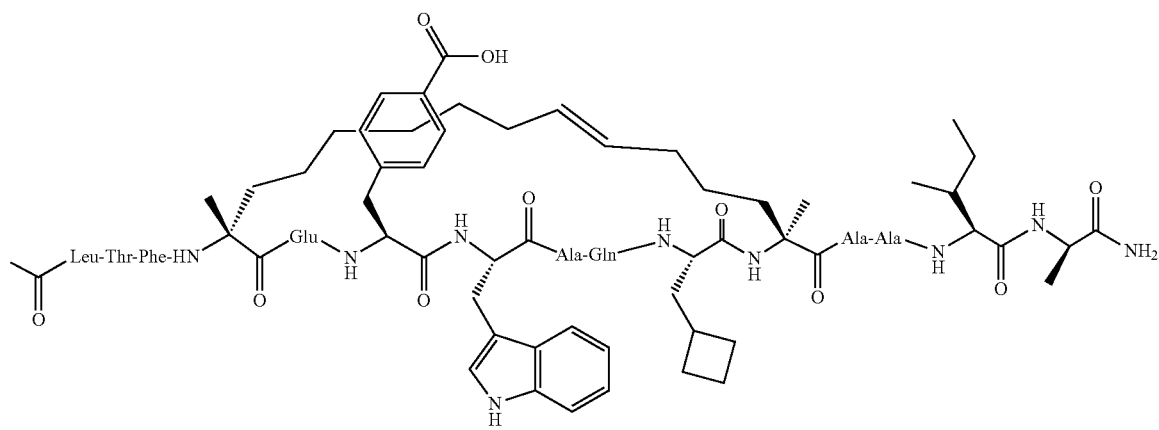
Ac-L T F $er8 E F4cooh WAQCba $e AA-I-a-NH2
Chemical Formula: $C_{94}H_{136}N_{18}O_{22}$
Exact Mass: 1869.01
Molecular Weight: 1870.19
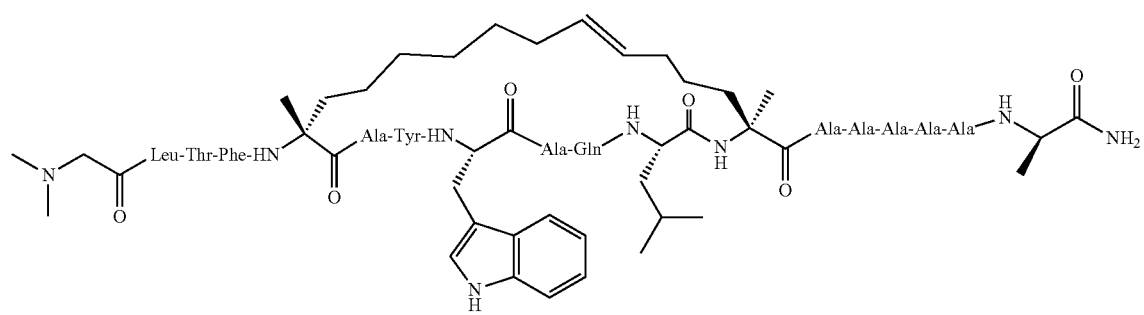
Dmaac-L T F $er8 AYWAQL $e AAAAA a-NH2
Chemical Formula: $C_{95}H_{143}N_{21}O_{21}$
Exact Mass: 1914.08
Molecular Weight: 1915.28
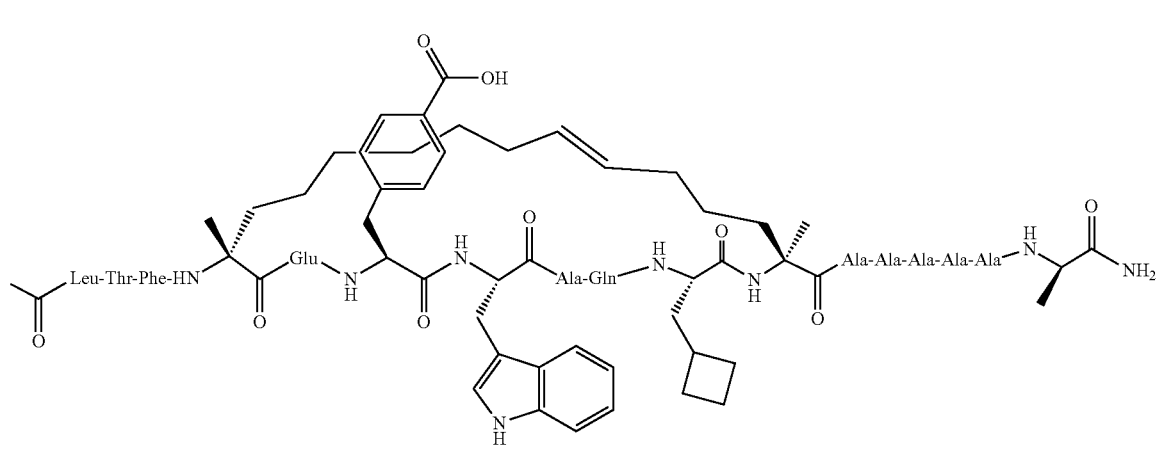
Ac-L T F $er8 E F4cooh WAQCba $e AAAAA a-NH2
Chemical Formula: $C_{97}H_{140}N_{20}O_{24}$
Exact Mass: 1969.03
Molecular Weight: 1970.27

TABLE 1c-continued
Structure
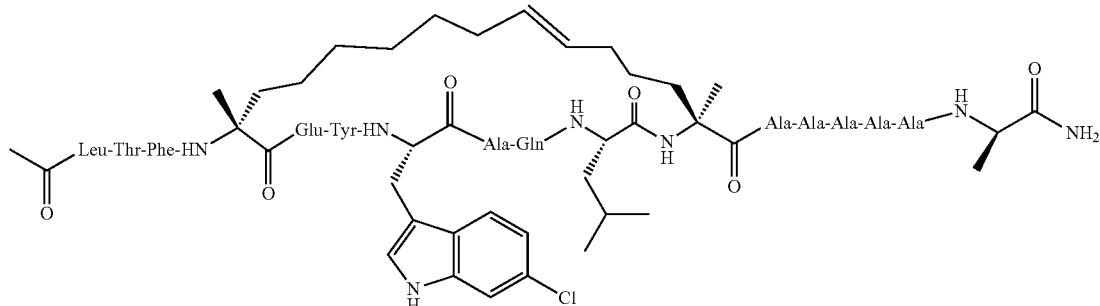
Ac-L T F $er8 EY6clWAQL $e AAAAA a-NH2
Chemical Formula: $C_{95}H_{139}ClN_{20}O_{23}$
Exact Mass: 1963.00
Molecular Weight: 1964.69
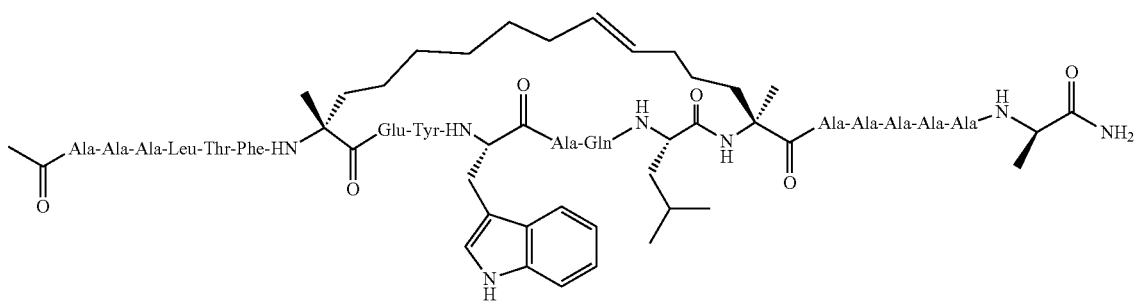
Ac-AAAL T F $er8 EYWAQL $e AAAAA a-NH2
Chemical Formula: $C_{104}H_{155}N_{23}O_{26}$
Exact Mass: 2142.15
Molecular Weight: 2143.48
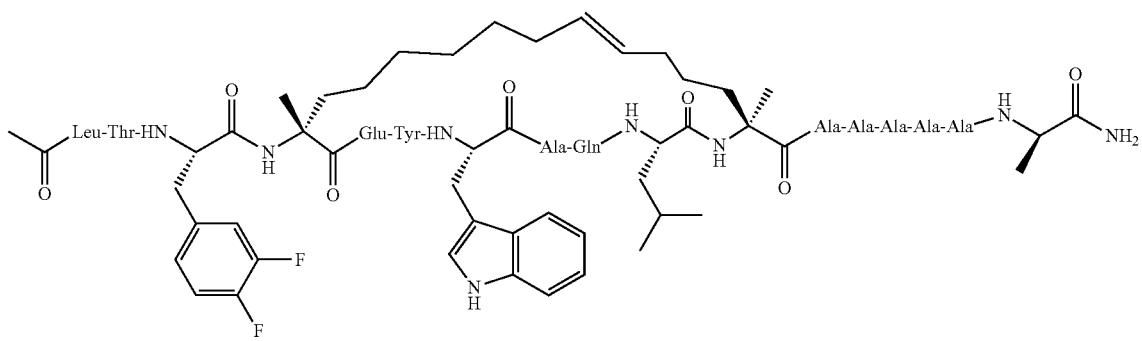
Ac-L T F34F2 $er8 EYWAQL $e AAAAA a-NH2
Chemical Formula: $C_{95}H_{138}F_2N_{20}O_{23}$
Exact Mass: 1965.02
Molecular Weight: 1966.23

TABLE 1c-continued
Structure
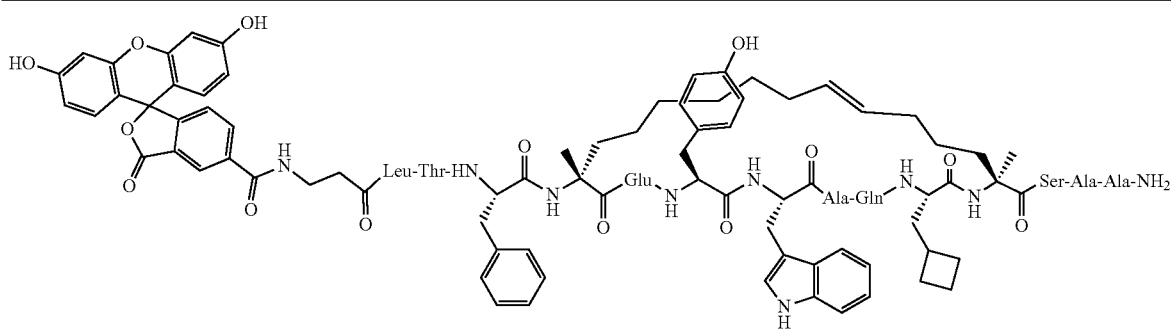
5-FAM- Ba L T F $er8EYWAQCba $e SAA-NH2
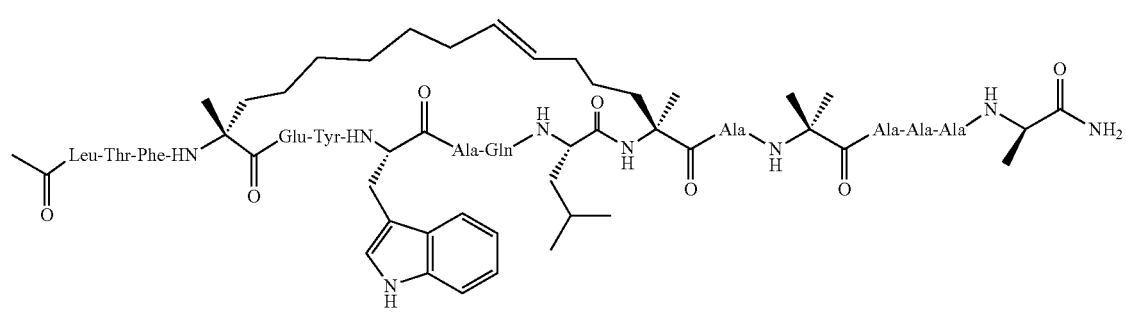
Ac-L T F $er8 EYWAQL $e AAib AAA a-NH2
Chemical Formula: $C_{96}H_{142}N_{20}O_{23}$
Exact Mass: 1943.06
Molecular Weight: 1944.27
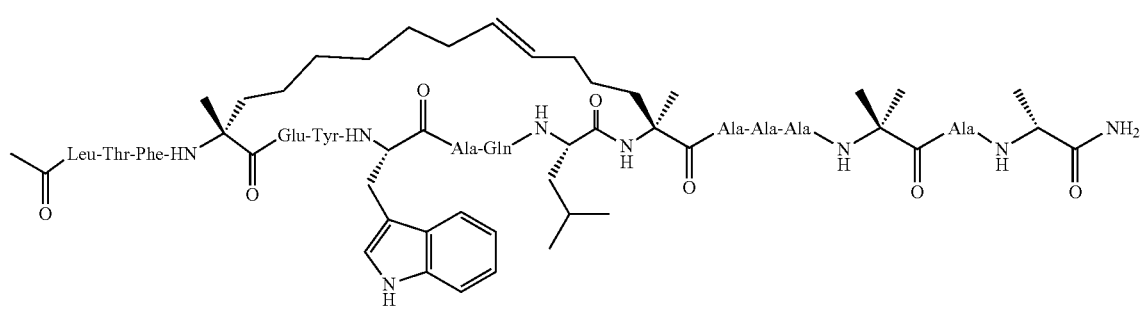
Ac-L T F $er8 EYWAQL $e AAA Aib A a-NH2
Chemical Formula: $C_{96}H_{142}N_{20}O_{23}$
Exact Mass: 1943.06
Molecular Weight: 1944.27
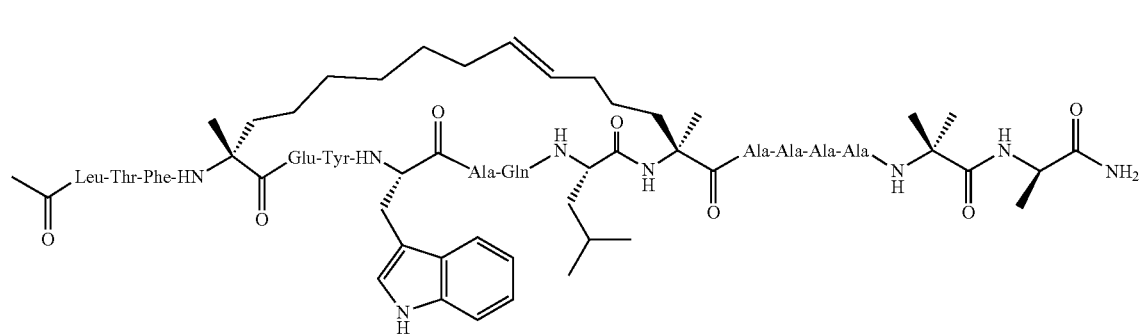

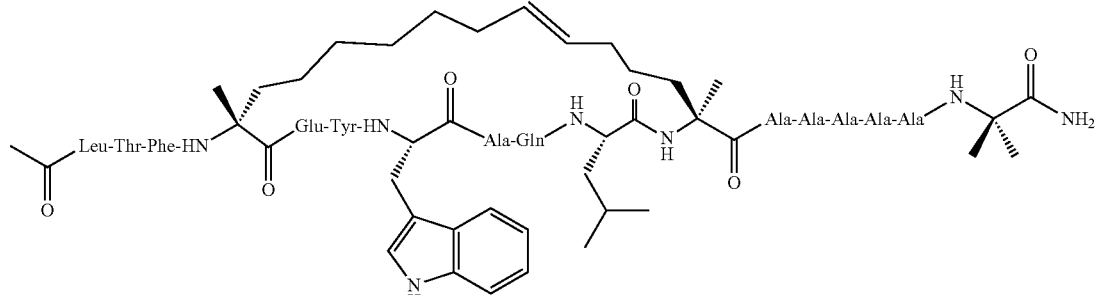
Ac-L T F $er8 EYWAQL $e AAAAAAib-NH2
Chemical Formula: $C_{96}H_{142}N_{20}O_{23}$
Exact Mass: 1943.06
Molecular Weight: 1944.27
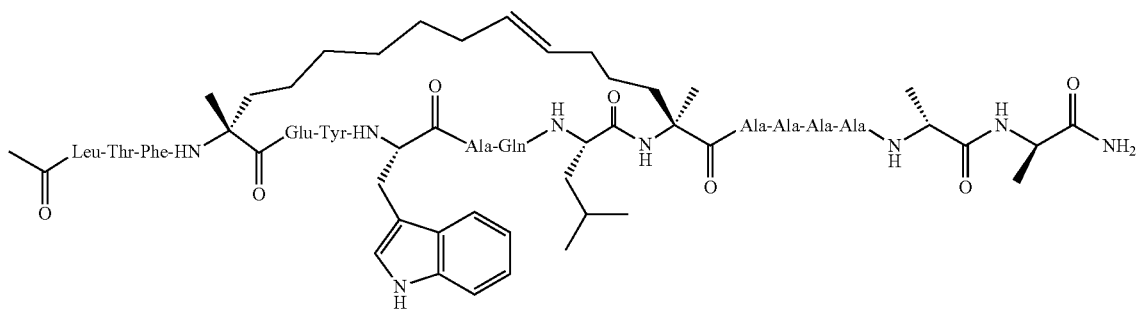
Ac-L T F $er8 EYWAQL $e AAAA a a-NH2
Chemical Formula: $C_{95}H_{140}N_{20}O_{23}$
Exact Mass: 1929.04
Molecular Weight: 1930.25
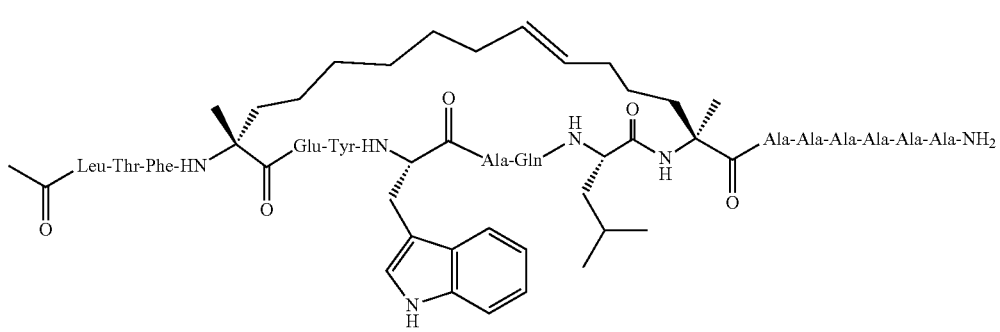
Ac-L T F $er8 EYWAQL $e AAAAAA-NH2
Chemical Formula: $C_{95}H_{140}N_{20}O_{23}$
Exact Mass: 1929.04
Molecular Weight: 1930.25

TABLE 1c-continued
Structure
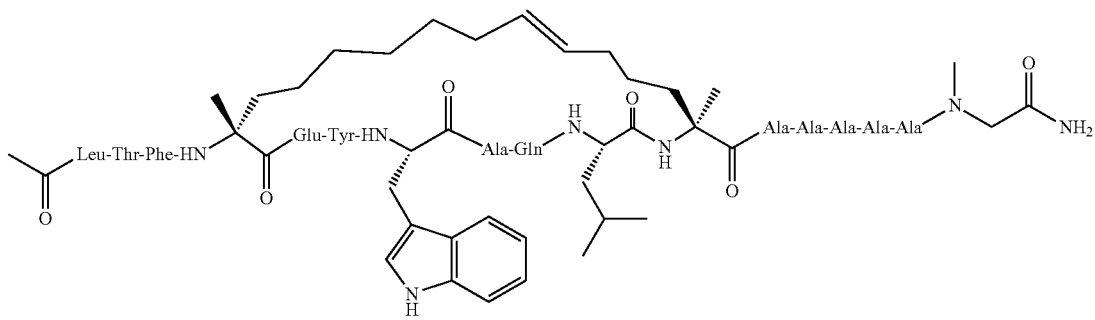
Ac-L T F $er8 EYWAQL $e AAAAA Sar-NH2
Chemical Formula: $C_{95}H_{140}N_{20}O_{23}$
Exact Mass: 1929.04
Molecular Weight: 1930.25
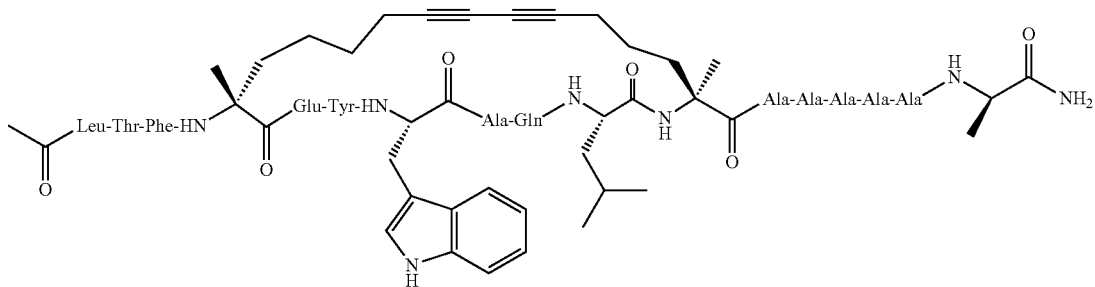
Ac-LTF$rda6EYWAQL$da5AAAAAa-NH2
Chemical Formula: $C_{95}H_{134}N_{20}O_{23}$
Exact Mass: 1922.99
Molecular Weight: 1924.20
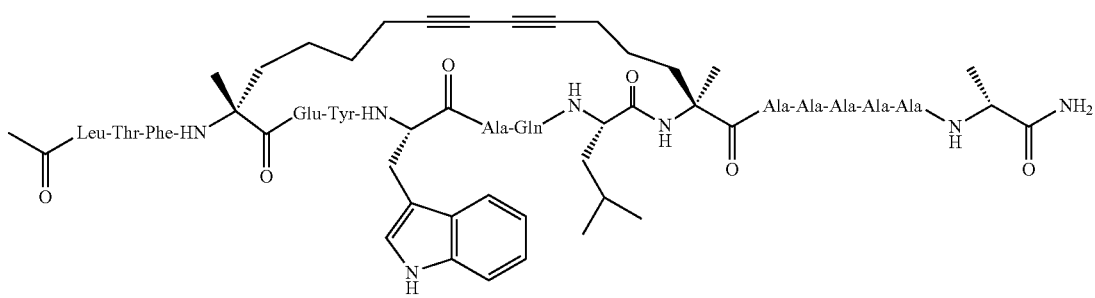
Ac-L T F $rda6EYWAQL $da5AAAAA a-NH2
Chemical Formula: $C_{95}H_{134}N_{20}O_{23}$
Exact Mass: 1922.99
Molecular Weight: 1924.20

TABLE 1c-continued

Structure

Leu-Thr-Phe-HN—[macrocyclic structure with diyne linker, Glu-Tyr-HN, Ala-Gln, Trp side chain, Leu side chain, Ala-Ala-Ala-Ala-Ala]—NH-CH(CH₃)-C(O)NH₂ (acetyl N-terminus)

Chemical Formula: $C_{96}H_{136}N_{20}O_{23}$
Exact Mass: 1937.01
Molecular Weight: 1938.23

In some embodiments, peptidomimetic macrocycles exclude peptidomimetic macrocycles shown in Table 2a:

TABLE 2a

| Number | SEQ ID NO: | Sequence |
|---|---|---|
| 1 | 704 | L$r5QETFSD$s8WKLLPEN |
| 2 | 705 | LSQ$r5TFSDLW$s8LLPEN |
| 3 | 706 | LSQE$r5FSDLWK$s8LPEN |
| 4 | 707 | LSQET$r5SDLWKL$s8PEN |
| 5 | 708 | LSQETF$r5DLWKLL$s8EN |
| 6 | 709 | LXQETFS$r5LWKLLP$s8N |
| 7 | 710 | LSQETFSD$r5WKLLPE$s8 |
| 8 | 711 | LSQQTF$r5DLWKLL$s8EN |
| 9 | 712 | LSQETF$r5DLWKLL$s8QN |
| 10 | 713 | LSQQTF$r5DLWKLL$s8QN |
| 11 | 714 | LSQETF$r5NLWKLL$s8QN |
| 12 | 715 | LSQQTF$r5NLWKLL$s8QN |
| 13 | 716 | LSQQTF$r5NLWRLL$s8QN |
| 14 | 717 | QSQQTF$r5NLWKLL$s8QN |
| 15 | 718 | QSQQTF$r5NLWRLL$s8QN |
| 16 | 719 | QSQQTA$r5NLWRLL$s8QN |
| 17 | 720 | L$r8QETFSD$WKLLPEN |
| 18 | 721 | LSQ$r8TFSDLW$LLPEN |
| 19 | 722 | LSQE$r8FSDLWK$LPEN |
| 20 | 723 | LSQET$r8SDLWKL$PEN |
| 21 | 724 | LSQETF$r8DLWKLL$EN |
| 22 | 725 | LXQETFS$r8LWKLLP$N |
| 23 | 726 | LSQETFSD$r8WKLLPE$ |
| 24 | 727 | LSQQTF$r8DLWKLL$EN |
| 25 | 728 | LSQETF$r8DLWKLL$QN |
| 26 | 729 | LSQQTF$rSDLWKLL$QN |
| 27 | 730 | LSQETF$r8NLWKLL$QN |
| 28 | 731 | LSQQTF$r8NLWKLL$QN |
| 29 | 732 | LSQQTF$r8NLWRLL$QN |
| 30 | 733 | QSQQTF$r8NLVVKLL$QN |
| 31 | 734 | QSQQTF$r8NLWRLL$QN |
| 32 | 735 | QSQQTA$r8NLVVRLL$QN |
| 33 | 736 | QSQQTF$r8NLWRKK$QN |
| 34 | 737 | QQTF$r8DLWRLL$EN |
| 35 | 738 | QQTF$r8DLWRLL$ |
| 36 | 739 | LSQQTF$DLW$LL |
| 37 | 740 | QQTF$DLW$LL |
| 38 | 741 | QQTA$r8DLWRLL$EN |
| 39 | 742 | QSQQTF$r5NLWRLL$s8QN (dihydroxylated olefin) |
| 40 | 743 | QSQQTA$r5NLWRLL$s8QN (dihydroxylated olefin) |
| 41 | 744 | QSQQTF$r8DLWRLL$QN |
| 42 | 745 | QTF$r8NLWRLL$ |
| 43 | 746 | QSQQTF$NLW$LLPQN |
| 44 | 747 | QS$QTF$NLWRLLPQN |
| 45 | 748 | $TFS$LWKLL |
| 46 | 749 | ETF$DLW$LL |
| 47 | 750 | QTF$NLW$LL |
| 48 | 751 | $SQE$FSNLWKLL |

In Table 2a, X represents S or any amino acid. Peptides shown can comprise an N-terminal capping group such as acetyl or an additional linker such as beta-alanine between the capping group and the start of the peptide sequence.

In some embodiments, peptidomimetic macrocycles do not comprise a peptidomimetic macrocycle structure as shown in Table 2a.

In other embodiments, peptidomimetic macrocycles exclude peptidomimetic macrocycles shown in Table 2b:

TABLE 2b

| Number | SEQ ID NO: | Sequence | Exact Mass | M + 2 | Observed mass (m/e) |
|---|---|---|---|---|---|
| 1 | 752 | Ac-LSQETF$r8DLWKLL$EN-NH2 | 2068.13 | 1035.07 | 1035.36 |
| 2 | 753 | Ac-LSQETF$r8NLWKLL$QN-NH2 | 2066.16 | 1034.08 | 1034.31 |
| 3 | 754 | Ac-LSQQTF$r8NLWRLL$QN-NH2 | 2093.18 | 1047.59 | 1047.73 |
| 4 | 755 | Ac-QSQQTF$r8NLWKLL$QN-NH2 | 2080.15 | 1041.08 | 1041.31 |
| 5 | 756 | Ac-QSQQTF$r8NLWRLL$QN-NH2 | 2108.15 | 1055.08 | 1055.32 |
| 6 | 757 | Ac-QSQQTA$r8NLWRLL$QN-NH2 | 2032.12 | 1017.06 | 1017.24 |
| 7 | 758 | Ac-QAibQQTF$r8NLWRLL$QN-NH2 | 2106.17 | 1054.09 | 1054.34 |
| 8 | 759 | Ac-QSQQTFSNLWRLLPQN-NH2 | 2000.02 | 1001.01 | 1001.26 |
| 9 | 760 | Ac-QSQQTF$/r8NLWRLL$/QN-NH2 | 2136.18 | 1069.09 | 1069.37 |
| 10 | 761 | Ac-QSQAibTF$r8NLWRLL$QN-NH2 | 2065.15 | 1033.58 | 1033.71 |
| 11 | 762 | Ac-QSQQTF$r8NLWRLL$AN-NH2 | 2051.13 | 1026.57 | 1026.70 |
| 12 | 763 | Ac-ASQQTF$r8NLWRLL$QN-NH2 | 2051.13 | 1026.57 | 1026.90 |
| 13 | 764 | Ac-QSQQTF$r8ALWRLL$QN-NH2 | 2065.15 | 1033.58 | 1033.41 |
| 14 | 765 | Ac-QSQETF$r8NLWRLL$QN-NH2 | 2109.14 | 1055.57 | 1055.70 |
| 15 | 766 | Ac-RSQQTF$r8NLWRLL$QN-NH2 | 2136.20 | 1069.10 | 1069.17 |
| 16 | 767 | Ac-RSQQTF$r8NLWRLL$EN-NH2 | 2137.18 | 1069.59 | 1069.75 |
| 17 | 768 | Ac-LSQETFSDLWKLLPEN-NH2 | 1959.99 | 981.00 | 981.24 |
| 18 | 769 | Ac-QSQ$TFS$LWRLLPQN-NH2 | 2008.09 | 1005.05 | 1004.97 |
| 19 | 770 | Ac-QSQQ$FSN$WRLLPQN-NH2 | 2036.06 | 1019.03 | 1018.86 |
| 20 | 771 | Ac-QSQQT$SNL$RLLPQN-NH2 | 1917.04 | 959.52 | 959.32 |
| 21 | 772 | Ac-QSQQTF$NLW$LLPQN-NH2 | 2007.06 | 1004.53 | 1004.97 |
| 22 | 773 | Ac-RTQATF$r8NQWAibANle$TNAibTR-NH2 | 2310.26 | 1156.13 | 1156.52 |
| 23 | 774 | Ac-QSQQTF$r8NLWRLL$RN-NH2 | 2136.20 | 1069.10 | 1068.94 |
| 24 | 775 | Ac-QSQRTF$r8NLWRLL$QN-NH2 | 2136.20 | 1069.10 | 1068.94 |
| 25 | 776 | Ac-QSQQTF$r8NNleWRLL$QN-NH2 | 2108.15 | 1055.08 | 1055.44 |
| 26 | 777 | Ac-QSQQTF$r8NLWRNleL$QN-NH2 | 2108.15 | 1055.08 | 1055.84 |
| 27 | 778 | Ac-QSQQTF$r8NLWRLNle$QN-NH2 | 2108.15 | 1055.08 | 1055.12 |
| 28 | 779 | Ac-QSQQTY$r8NLWRLL$QN-NH2 | 2124.15 | 1063.08 | 1062.92 |
| 29 | 780 | Ac-RAibQQTF$r8NLWRLL$QN-NH2 | 2134.22 | 1068.11 | 1068.65 |
| 30 | 781 | Ac-MPRFMDYWEGLN-NH2 | 1598.70 | 800.35 | 800.45 |
| 31 | 782 | Ac-RSQQRF$r8NLWRLL$QN-NH2 | 2191.25 | 1096.63 | 1096.83 |
| 32 | 783 | Ac-QSQQRF$r8NLWRLL$QN-NH2 | 2163.21 | 1082.61 | 1082.87 |
| 33 | 784 | Ac-RAibQQRF$r8NLWRLL$QN-NH2 | 2189.27 | 1095.64 | 1096.37 |
| 34 | 785 | Ac-RSQQRF$r8NFWRLL$QN-NH2 | 2225.23 | 1113.62 | 1114.37 |

TABLE 2b-continued

| Number | SEQ ID NO: | Sequence | Exact Mass | M + 2 | Observed mass (m/e) |
|---|---|---|---|---|---|
| 35 | 786 | Ac-RSQQRF$r8NYWRLL$QN-NH2 | 2241.23 | 1121.62 | 1122.37 |
| 36 | 787 | Ac-RSQQTF$r8NLWQLL$QN-NH2 | 2108.15 | 1055.08 | 1055.29 |
| 37 | 788 | Ac-QSQQTF$r8NLWQAmlL$QN-NH2 | 2094.13 | 1048.07 | 1048.32 |
| 38 | 789 | Ac-QSQQTF$r8NAmlWRLL$QN-NH2 | 2122.17 | 1062.09 | 1062.35 |
| 39 | 790 | Ac-NlePRF$r8DYWEGL$QN-NH2 | 1869.98 | 935.99 | 936.20 |
| 40 | 791 | Ac-NlePRF$r8NYWRLL$QN-NH2 | 1952.12 | 977.06 | 977.35 |
| 41 | 792 | Ac-RF$r8NLWRLL$Q-NH2 | 1577.96 | 789.98 | 790.18 |
| 42 | 793 | Ac-QSQQTF$r8N2ffWRLL$QN-NH2 | 2160.13 | 1081.07 | 1081.40 |
| 43 | 794 | Ac-QSQQTF$r8N3ffWRLL$QN-NH2 | 2160.13 | 1081.07 | 1081.34 |
| 44 | 795 | Ac-QSQQTF#r8NLWRLL#QN-NH2 | 2080.12 | 1041.06 | 1041.34 |
| 45 | 796 | Ac-RSQQTA$r8NLWRLL$QN-NH2 | 2060.16 | 1031.08 | 1031.38 |
| 46 | 797 | Ac-QSQQTF%r8NLWRLL%QN-NH2 | 2110.17 | 1056.09 | 1056.55 |
| 47 | 798 | HepQSQ$TFSNLWRLLPQN-NH2 | 2051.10 | 1026.55 | 1026.82 |
| 48 | 799 | HepQSQ$TF$r8NLWRLL$QN-NH2 | 2159.23 | 1080.62 | 1080.89 |
| 49 | 800 | Ac-QSQQTF$r8NL6clWRLL$QN-NH2 | 2142.11 | 1072.06 | 1072.35 |
| 50 | 801 | Ac-QSQQTF$r8NLMe6clwRLL$QN-NH2 | 2156.13 | 1079.07 | 1079.27 |
| 51 | 802 | Ac-LTFEHYWAQLTS-NH2 | 1535.74 | 768.87 | 768.91 |
| 52 | 803 | Ac-LTF$HYW$QLTS-NH2 | 1585.83 | 793.92 | 794.17 |
| 53 | 804 | Ac-LTFE$YWA$LTS-NH2 | 1520.79 | 761.40 | 761.67 |
| 54 | 805 | Ac-LTF$zr8HYWAQL$zS-NH2 | 1597.87 | 799.94 | 800.06 |
| 55 | 806 | Ac-LTF$r8HYWRQL$S-NH2 | 1682.93 | 842.47 | 842.72 |
| 56 | 807 | Ac-QS$QTFStNLWRLL$s8QN-NH2 | 2145.21 | 1073.61 | 1073.90 |
| 57 | 808 | Ac-QSQQTASNLWRLLPQN-NH2 | 1923.99 | 963.00 | 963.26 |
| 58 | 809 | Ac-QSQQTA$/r8NLWRLL$/QN-NH2 | 2060.15 | 1031.08 | 1031.24 |
| 59 | 810 | Ac-ASQQTF$/r8NLWRLL$/QN-NH2 | 2079.16 | 1040.58 | 1040.89 |
| 60 | 811 | Ac-$SQQ$FSNLWRLLAibQN-NH2 | 2009.09 | 1005.55 | 1005.86 |
| 61 | 812 | Ac-QS$QTF$NLWRLLAibQN-NH2 | 2023.10 | 1012.55 | 1012.79 |
| 62 | 813 | Ac-QSQQ$FSN$WRLLAibQN-NH2 | 2024.06 | 1013.03 | 1013.31 |
| 63 | 814 | Ac-QSQQTF$NLW$LLAibQN-NH2 | 1995.06 | 998.53 | 998.87 |
| 64 | 815 | Ac-QSQQTFS$LWR$LAibQN-NH2 | 2011.06 | 1006.53 | 1006.83 |
| 65 | 816 | Ac-QSQQTFSNLW$LLA$N-NH2 | 1940.02 | 971.01 | 971.29 |
| 66 | 817 | Ac-$/SQQ$/FSNLWRLLAibQN-NH2 | 2037.12 | 1019.56 | 1019.78 |
| 67 | 818 | Ac-QS$/QTF$/NLWRLLAibQN-NH2 | 2051.13 | 1026.57 | 1026.90 |
| 68 | 819 | Ac-QSQQ$/FSN$/WRLLAibQN-NH2 | 2052.09 | 1027.05 | 1027.36 |
| 69 | 820 | Ac-QSQQTF$/NLW$/LLAibQN-NH2 | 2023.09 | 1012.55 | 1013.82 |
| 70 | 821 | Ac-QSQ$TFS$LWRLLAibQN-NH2 | 1996.09 | 999.05 | 999.39 |
| 71 | 822 | Ac-QSQ$/TFS$/LWRLLAibQN-NH2 | 2024.12 | 1013.06 | 1013.37 |
| 72 | 823 | Ac-QS$/QTFSt//NLWRLL$/s8QN-NH2 | 2201.27 | 1101.64 | 1102.00 |

TABLE 2b-continued

| Number | SEQ ID NO: | Sequence | Exact Mass | M + 2 | Observed mass (m/e) |
|---|---|---|---|---|---|
| 73 | 824 | Ac-$r8SQQTFSSLWRLLAibQN-NH2 | 2038.14 | 1020.07 | 1020.23 |
| 74 | 825 | Ac-QSQ$r8TFSNLW$LLAibQN-NH2 | 1996.08 | 999.04 | 999.32 |
| 75 | 826 | Ac-QSQQTFS$r8LWRLLA$N-NH2 | 2024.12 | 1013.06 | 1013.37 |
| 76 | 827 | Ac-QS$r5QTFStNLW$LLAibQN-NH2 | 2032.12 | 1017.06 | 1017.39 |
| 77 | 828 | Ac-$/r8SQQTFS$/LWRLLAibQN-NH2 | 2066.17 | 1034.09 | 1034.80 |
| 78 | 829 | Ac-QSQ$/r8TFSNLW$/LLAibQN-NH2 | 2024.11 | 1013.06 | 1014.34 |
| 79 | 830 | Ac-QSQQTFS$/r8LWRLLA$/N-NH2 | 2052.15 | 1027.08 | 1027.16 |
| 80 | 831 | Ac-QS$/r5QTFSt//NLW$/LLAibQN-NH2 | 2088.18 | 1045.09 | 1047.10 |
| 81 | 832 | Ac-QSQQTFSNLWRLLAibQN-NH2 | 1988.02 | 995.01 | 995.31 |
| 82 | 833 | Hep/QSQ$/TF$/r8NLWRLL$/QN-NH2 | 2215.29 | 1108.65 | 1108.93 |
| 83 | 834 | Ac-ASQQTF$r8NLRWLL$QN-NH2 | 2051.13 | 1026.57 | 1026.90 |
| 84 | 835 | Ac-QSQQTF$/r8NLWRLL$/Q-NH2 | 2022.14 | 1012.07 | 1012.66 |
| 85 | 836 | Ac-QSQQTF$r8NLWRLL$Q-NH2 | 1994.11 | 998.06 | 998.42 |
| 86 | 837 | Ac-AAARAA$r8AAARAA$AA-NH2 | 1515.90 | 758.95 | 759.21 |
| 87 | 838 | Ac-LTFEHYWAQLTSA-NH2 | 1606.78 | 804.39 | 804.59 |
| 88 | 839 | Ac-LTF$r8HYWAQL$SA-NH2 | 1668.90 | 835.45 | 835.67 |
| 89 | 840 | Ac-ASQQTFSNLWRLLPQN-NH2 | 1943.00 | 972.50 | 973.27 |
| 90 | 841 | Ac-QS$QTFStNLW$r5LLAibQN-NH2 | 2032.12 | 1017.06 | 1017.30 |
| 91 | 842 | Ac-QSQQTFAibNLWRLLAibQN-NH2 | 1986.04 | 994.02 | 994.19 |
| 92 | 843 | Ac-QSQQTFNleNLWRLLNleQN-NH2 | 2042.11 | 1022.06 | 1022.23 |
| 93 | 844 | Ac-QSQQTF$/r8NLWRLLAibQN-NH2 | 2082.14 | 1042.07 | 1042.23 |
| 94 | 845 | Ac-QSQQTF$/r8NLWRLLNleQN-NH2 | 2110.17 | 1056.09 | 1056.29 |
| 95 | 846 | Ac-QSQQTFAibNLWRLL$/QN-NH2 | 2040.09 | 1021.05 | 1021.25 |
| 96 | 847 | Ac-QSQQTFNleNLWRLL$/QN-NH2 | 2068.12 | 1035.06 | 1035.31 |
| 97 | 848 | Ac-QSQQTF%r8NL6clWRNleL%QN-NH2 | 2144.13 | 1073.07 | 1073.32 |
| 98 | 849 | Ac-QSQQTF%r8NLMe6clWRLL%QN-NH2 | 2158.15 | 1080.08 | 1080.31 |
| 101 | 850 | Ac-FNleSYWE$L-NH2 | 1160.63 | — | 1161.70 |
| 102 | 851 | Ac-F$r8AYWELL$A-NH2 | 1344.75 | — | 1345.90 |
| 103 | 852 | Ac-F$r8AYWQLL$A-NH2 | 1343.76 | — | 1344.83 |
| 104 | 853 | Ac-NlePRF$r8NYWELL$QN-NH2 | 1925.06 | 963.53 | 963.69 |
| 105 | 854 | Ac-NlePRF$r8DYWRLL$QN-NH2 | 1953.10 | 977.55 | 977.68 |
| 106 | 855 | Ac-NlePRF$r8NYWRLL$Q-NH2 | 1838.07 | 920.04 | 920.18 |
| 107 | 856 | Ac-NlePRF$r8NYWRLL$-NH2 | 1710.01 | 856.01 | 856.13 |
| 108 | 857 | Ac-QSQQTF$r8DLWRLL$QN-NH2 | 2109.14 | 1055.57 | 1055.64 |
| 109 | 858 | Ac-QSQQTF$r8NLWRLL$EN-NH2 | 2109.14 | 1055.57 | 1055.70 |
| 110 | 859 | Ac-QSQQTF$r8NLWRLL$QD-NH2 | 2109.14 | 1055.57 | 1055.64 |
| 111 | 860 | Ac-QSQQTF$r8NLWRLL$S-NH2 | 1953.08 | 977.54 | 977.60 |
| 112 | 861 | Ac-ESQQTF$r8NLWRLL$QN-NH2 | 2109.14 | 1055.57 | 1055.70 |

TABLE 2b-continued

| Number | SEQ ID NO: | Sequence | Exact Mass | M + 2 | Observed mass (m/e) |
|---|---|---|---|---|---|
| 113 | 862 | Ac-LTF$r8NLWRNleL$Q-NH2 | 1635.99 | 819.00 | 819.10 |
| 114 | 863 | Ac-LRF$r8NLWRNleL$Q-NH2 | 1691.04 | 846.52 | 846.68 |
| 115 | 864 | Ac-QSQQTF$r8NWWRNleL$QN-NH2 | 2181.15 | 1091.58 | 1091.64 |
| 116 | 865 | Ac-QSQQTF$r8NLWRNleL$Q-NH2 | 1994.11 | 998.06 | 998.07 |
| 117 | 866 | Ac-QTF$r8NLWRNleL$QN-NH2 | 1765.00 | 883.50 | 883.59 |
| 118 | 867 | Ac-NlePRF$r8NWWRLL$QN-NH2 | 1975.13 | 988.57 | 988.75 |
| 119 | 868 | Ac-NlePRF$r8NWWRLL$A-NH2 | 1804.07 | 903.04 | 903.08 |
| 120 | 869 | Ac-TSFAEYWNLLNH2 | 1467.70 | 734.85 | 734.90 |
| 121 | 870 | Ac-QTF$r8HWWSQL$S-NH2 | 1651.85 | 826.93 | 827.12 |
| 122 | 871 | Ac-FM$YWE$L-NH2 | 1178.58 | — | 1179.64 |
| 123 | 872 | Ac-QTFEHWWSQLLS-NH2 | 1601.76 | 801.88 | 801.94 |
| 124 | 873 | Ac-QSQQTF$r8NLAmwRLNle$QN-NH2 | 2122.17 | 1062.09 | 1062.24 |
| 125 | 874 | Ac-FMAibY6clWEAc3cL-NH2 | 1130.47 | — | 1131.53 |
| 126 | 875 | Ac-FNle$Y6clWE$L-NH2 | 1194.59 | — | 1195.64 |
| 127 | 876 | Ac-F$zr8AY6clWEAc3cL$z-NH2 | 1277.63 | 639.82 | 1278.71 |
| 128 | 877 | Ac-F$r8AY6clWEAc3cL$A-NH2 | 1348.66 | — | 1350.72 |
| 129 | 878 | Ac-NlePRF$r8NY6clWRLL$QN-NH2 | 1986.08 | 994.04 | 994.64 |
| 130 | 879 | Ac-AF$r8AAWALA$A-NH2 | 1223.71 | — | 1224.71 |
| 131 | 880 | Ac-TF$r8AAWRLA$Q-NH2 | 1395.80 | 698.90 | 399.04 |
| 132 | 881 | Pr-TF$r8AAWRLA$Q-NH2 | 1409.82 | 705.91 | 706.04 |
| 133 | 882 | Ac-QSQQTF%r8NLWRNleL%QN-NH2 | 2110.17 | 1056.09 | 1056.22 |
| 134 | 883 | Ac-LTF%r8HYWAQL%SA-NH2 | 1670.92 | 836.46 | 836.58 |
| 135 | 884 | Ac-NlePRF%r8NYWRLL%QN-NH2 | 1954.13 | 978.07 | 978.19 |
| 136 | 885 | Ac-NlePRF%r8NY6clWRLL%QN-NH2 | 1988.09 | 995.05 | 995.68 |
| 137 | 886 | Ac-LTF%r8HY6clWAQL%S-NH2 | 1633.84 | 817.92 | 817.93 |
| 138 | 887 | Ac-QS%QTF%StNLWRLL%s8QN-NH2 | 2149.24 | 1075.62 | 1075.65 |
| 139 | 888 | Ac-LTF%r8HY6clWRQL%S-NH2 | 1718.91 | 860.46 | 860.54 |
| 140 | 889 | Ac-QSQQTF%r8NL6clWRLL%QN-NH2 | 2144.13 | 1073.07 | 1073.64 |
| 141 | 890 | Ac-%r8SQQTFS%LWRLLAibQN-NH2 | 2040.15 | 1021.08 | 1021.13 |
| 142 | 891 | Ac-LTF%r8HYWAQL%S-NH2 | 1599.88 | 800.94 | 801.09 |
| 143 | 892 | Ac-TSF%r8QYWNLL%P-NH2 | 1602.88 | 802.44 | 802.58 |
| 147 | 893 | Ac-LTFEHYWAQLTS-NH2 | 1535.74 | 768.87 | 769.5 |
| 152 | 894 | Ac-F$er8AY6clWEAc3cL$e-NH2 | 1277.63 | 639.82 | 1278.71 |
| 153 | 895 | Ac-AF$r8AAWALA$A-NH2 | 1277.63 | 639.82 | 1277.84 |
| 154 | 896 | Ac-TF$r8AAWRLA$Q-NH2 | 1395.80 | 698.90 | 699.04 |
| 155 | 897 | Pr-TF$r8AAWRLA$Q-NH2 | 1409.82 | 705.91 | 706.04 |
| 156 | 898 | Ac-LTF$er8HYWAQL$eS-NH2 | 1597.87 | 799.94 | 800.44 |
| 159 | 899 | Ac-CCPGCCBaQSQQTF$r8NLWRLL$QN-NH2 | 2745.30 | 1373.65 | 1372.99 |

TABLE 2b-continued

| Number | SEQ ID NO: | Sequence | Exact Mass | M + 2 | Observed mass (m/e) |
|---|---|---|---|---|---|
| 160 | 900 | Ac-CCPGCCBaQSQQTA$r8NLWRLL$QN-NH2 | 2669.27 | 1335.64 | 1336.09 |
| 161 | 901 | Ac-CCPGCCBaNlePRF$r8NYWRLL$QN-NH2 | 2589.26 | 1295.63 | 1296.2 |
| 162 | 902 | Ac-LTF$/r8HYWAQL$/S-NH2 | 1625.90 | 813.95 | 814.18 |
| 163 | 903 | Ac-F%r8HY6clWRAc3cL%-NH2 | 1372.72 | 687.36 | 687.59 |
| 164 | 904 | Ac-QTF%r8HWWSQL%S-NH2 | 1653.87 | 827.94 | 827.94 |
| 165 | 905 | Ac-LTA$r8HYWRQL$S-NH2 | 1606.90 | 804.45 | 804.66 |
| 166 | 906 | Ac-Q$r8QQTFSN$WRLLAibQN-NH2 | 2080.12 | 1041.06 | 1041.61 |
| 167 | 907 | Ac-QSQQ$r8FSNLWR$LAibQN-NH2 | 2066.11 | 1034.06 | 1034.58 |
| 168 | 908 | Ac-F$r8AYWEAc3cL$A-NH2 | 1314.70 | 658.35 | 1315.88 |
| 169 | 909 | Ac-F$r8AYWEAc3cL$S-NH2 | 1330.70 | 666.35 | 1331.87 |
| 170 | 910 | Ac-F$r8AYWEAc3cL$Q-NH2 | 1371.72 | 686.86 | 1372.72 |
| 171 | 911 | Ac-F$r8AYWEAibL$S-NH2 | 1332.71 | 667.36 | 1334.83 |
| 172 | 912 | Ac-F$r8AYWEAL$S-NH2 | 1318.70 | 660.35 | 1319.73 |
| 173 | 913 | Ac-F$r8AYWEQL$S-NH2 | 1375.72 | 688.86 | 1377.53 |
| 174 | 914 | Ac-F$r8HYWEQL$S-NH2 | 1441.74 | 721.87 | 1443.48 |
| 175 | 915 | Ac-F$r8HYWAQL$S-NH2 | 1383.73 | 692.87 | 1385.38 |
| 176 | 916 | Ac-F$r8HYWAAc3cL$S-NH2 | 1338.71 | 670.36 | 1340.82 |
| 177 | 917 | Ac-F$r8HYWRAc3cL$S-NH2 | 1423.78 | 712.89 | 713.04 |
| 178 | 918 | Ac-F$r8AYWEAc3cL#A-NH2 | 1300.69 | 651.35 | 1302.78 |
| 179 | 919 | Ac-NlePTF%r8NYWRLL%QN-NH2 | 1899.08 | 950.54 | 950.56 |
| 180 | 920 | Ac-TF$r8AAWRAL$Q-NH2 | 1395.80 | 698.90 | 699.13 |
| 181 | 921 | Ac-TSF%r8HYWAQL%S-NH2 | 1573.83 | 787.92 | 787.98 |
| 184 | 922 | Ac-F%r8AY6clWEAc3cL%A-NH2 | 1350.68 | 676.34 | 676.91 |
| 185 | 923 | Ac-LTF$r8HYWAQI$S-NH2 | 1597.87 | 799.94 | 800.07 |
| 186 | 924 | Ac-LTF$r8HYWAQNle$S-NH2 | 1597.87 | 799.94 | 800.07 |
| 187 | 925 | Ac-LTF$r8HYWAQL$A-NH2 | 1581.87 | 791.94 | 792.45 |
| 188 | 926 | Ac-LTF$r8HYWAQL$Abu-NH2 | 1595.89 | 798.95 | 799.03 |
| 189 | 927 | Ac-LTF$r8HYWAbuQL$S-NH2 | 1611.88 | 806.94 | 807.47 |
| 190 | 928 | Ac-LTF$er8AYWAQL$eS-NH2 | 1531.84 | 766.92 | 766.96 |
| 191 | 929 | Ac-LAF$r8HYWAQL$S-NH2 | 1567.86 | 784.93 | 785.49 |
| 192 | 930 | Ac-LAF$r8AYWAQL$S-NH2 | 1501.83 | 751.92 | 752.01 |
| 193 | 931 | Ac-LTF$er8AYWAQL$eA-NH2 | 1515.85 | 758.93 | 758.97 |
| 194 | 932 | Ac-LAF$r8AYWAQL$A-NH2 | 1485.84 | 743.92 | 744.05 |
| 195 | 933 | Ac-LTF$r8NLWANleL$Q-NH2 | 1550.92 | 776.46 | 776.61 |
| 196 | 934 | Ac-LTF$r8NLWANleL$A-NH2 | 1493.90 | 747.95 | 1495.6 |
| 197 | 935 | Ac-LTF$r8ALWANleL$Q-NH2 | 1507.92 | 754.96 | 755 |

TABLE 2b-continued

| Number | SEQ ID NO: | Sequence | Exact Mass | M + 2 | Observed mass (m/e) |
|---|---|---|---|---|---|
| 198 | 936 | Ac-LAF$r8NLWANleL$Q-NH2 | 1520.91 | 761.46 | 761.96 |
| 199 | 937 | Ac-LAF$r8ALWANleL$A-NH2 | 1420.89 | 711.45 | 1421.74 |
| 200 | 938 | Ac-A$r8AYWEAc3cL$A-NH2 | 1238.67 | 620.34 | 1239.65 |
| 201 | 939 | Ac-F$r8AYWEAc3cL$AA-NH2 | 1385.74 | 693.87 | 1386.64 |
| 202 | 940 | Ac-F$r8AYWEAc3cL$Abu-NH2 | 1328.72 | 665.36 | 1330.17 |
| 203 | 941 | Ac-F$r8AYWEAc3cL$Nle-NH2 | 1356.75 | 679.38 | 1358.22 |
| 204 | 942 | Ac-F$r5AYWEAc3cL$s8A-NH2 | 1314.70 | 658.35 | 1315.51 |
| 205 | 943 | Ac-F$AYWEAc3cL$r8A-NH2 | 1314.70 | 658.35 | 1315.66 |
| 206 | 944 | Ac-F$r8AYWEAc3cI$A-NH2 | 1314.70 | 658.35 | 1316.18 |
| 207 | 945 | Ac-FSr8AYWEAc3cNle$A-NH2 | 1314.70 | 658.35 | 1315.66 |
| 208 | 946 | Ac-F$r8AYWEAmlL$A-NH2 | 1358.76 | 680.38 | 1360.21 |
| 209 | 947 | Ac-F$r8AYWENleL$A-NH2 | 1344.75 | 673.38 | 1345.71 |
| 210 | 948 | Ac-F$r8AYWQAc3cL$A-NH2 | 1313.72 | 657.86 | 1314.7 |
| 211 | 949 | Ac-F$r8AYWAAc3cL$A-NH2 | 1256.70 | 629.35 | 1257.56 |
| 212 | 950 | Ac-F$r8AYWAbuAc3cL$A-NH2 | 1270.71 | 636.36 | 1272.14 |
| 213 | 951 | Ac-F$r8AYWNleAc3cL$A-NH2 | 1298.74 | 650.37 | 1299.67 |
| 214 | 952 | Ac-F$r8AbuYWEAc3cL$A-NH2 | 1328.72 | 665.36 | 1329.65 |
| 215 | 953 | Ac-F$r8NleYWEAc3cL$A-NH2 | 1356.75 | 679.38 | 1358.66 |
| 216 | 954 | 5-FAM-BaLTFEHYWAQLTS-NH2 | 1922.82 | 962.41 | 962.87 |
| 217 | 955 | 5-FAM-BaLTF%r8HYWAQL%S-NH2 | 1986.96 | 994.48 | 994.97 |
| 218 | 956 | Ac-LTF$r8HYWAQhL$S-NH2 | 1611.88 | 806.94 | 807 |
| 219 | 957 | Ac-LTF$r8HYWAQTle$S-NH2 | 1597.87 | 799.94 | 799.97 |
| 220 | 958 | Ac-LTF$r8HYWAQAdm$S-NH2 | 1675.91 | 838.96 | 839.09 |
| 221 | 959 | Ac-LTF$r8HYWAQhCha$S-NH2 | 1651.91 | 826.96 | 826.98 |
| 222 | 960 | Ac-LTF$r8HYWAQCha$S-NH2 | 1637.90 | 819.95 | 820.02 |
| 223 | 961 | Ac-LTF$r8HYWAc6cQL$S-NH2 | 1651.91 | 826.96 | 826.98 |
| 224 | 962 | Ac-LTF$r8HYWAc5cQL$S-NH2 | 1637.90 | 819.95 | 820.02 |
| 225 | 963 | Ac-LThF$r8HYWAQL$S-NH2 | 1611.88 | 806.94 | 807 |
| 226 | 964 | Ac-LTIgl$r8HYWAQL$S-NH2 | 1625.90 | 813.95 | 812.99 |
| 227 | 965 | Ac-LTF$r8HYWAQChg$S-NH2 | 1623.88 | 812.94 | 812.99 |
| 228 | 966 | Ac-LTF$r8HYWAQF$S-NH2 | 1631.85 | 816.93 | 816.99 |
| 229 | 967 | Ac-LTF$r8HYWAQIgl$S-NH2 | 1659.88 | 830.94 | 829.94 |
| 230 | 968 | Ac-LTF$r8HYWAQCba$S-NH2 | 1609.87 | 805.94 | 805.96 |
| 231 | 969 | Ac-LTF$r8HYWAQCpg$S-NH2 | 1609.87 | 805.94 | 805.96 |
| 232 | 970 | Ac-LTF$r8HhYWAQL$S-NH2 | 1611.88 | 806.94 | 807 |
| 233 | 971 | Ac-F$r8AYWEAc3chL$A-NH2 | 1328.72 | 665.36 | 665.43 |
| 234 | 972 | Ac-F$r8AYWEAc3cTle$A-NH2 | 1314.70 | 658.35 | 1315.62 |
| 235 | 973 | Ac-F$r8AYWEAc3cAdm$A-NH2 | 1392.75 | 697.38 | 697.47 |

TABLE 2b-continued

| Number | SEQ ID NO: | Sequence | Exact Mass | M + 2 | Observed mass (m/e) |
|---|---|---|---|---|---|
| 236 | 974 | Ac-F$r8AYWEAc3chCha$A-NH2 | 1368.75 | 685.38 | 685.34 |
| 237 | 975 | Ac-F$r8AYWEAc3cCha$A-NH2 | 1354.73 | 678.37 | 678.38 |
| 238 | 976 | Ac-F$r8AYWEAc6cL$A-NH2 | 1356.75 | 679.38 | 679.42 |
| 239 | 977 | Ac-F$r8AYWEAc5cL$A-NH2 | 1342.73 | 672.37 | 672.46 |
| 240 | 978 | Ac-hF$r8AYWEAc3cL$A-NH2 | 1328.72 | 665.36 | 665.43 |
| 241 | 979 | Ac-Igl$r8AYWEAc3cL$A-NH2 | 1342.73 | 672.37 | 671.5 |
| 243 | 980 | Ac-F$r8AYWEAc3cF$A-NH2 | 1348.69 | 675.35 | 675.35 |
| 244 | 981 | Ac-F$r8AYWEAc3cIgl$A-NH2 | 1376.72 | 689.36 | 688.37 |
| 245 | 982 | Ac-F$r8AYWEAc3cCba$A-NH2 | 1326.70 | 664.35 | 664.47 |
| 246 | 983 | Ac-F$r8AYWEAc3cCpg$A-NH2 | 1326.70 | 664.35 | 664.39 |
| 247 | 984 | Ac-F$r8AhYWEAc3cL$A-NH2 | 1328.72 | 665.36 | 665.43 |
| 248 | 985 | Ac-F$r8AYWEAc3cL$Q-NH2 | 1371.72 | 686.86 | 1372.87 |
| 249 | 986 | Ac-F$r8AYWEAibL$A-NH2 | 1316.72 | 659.36 | 1318.18 |
| 250 | 987 | Ac-F$r8AYWEAL$A-NH2 | 1302.70 | 652.35 | 1303.75 |
| 251 | 988 | Ac-LAF$r8AYWAAL$A-NH2 | 1428.82 | 715.41 | 715.49 |
| 252 | 989 | Ac-LTF$r8HYWAAc3cL$S-NH2 | 1552.84 | 777.42 | 777.5 |
| 253 | 990 | Ac-NleTF$r8HYWAQL$S-NH2 | 1597.87 | 799.94 | 800.04 |
| 254 | 991 | Ac-VTF$r8HYWAQL$S-NH2 | 1583.85 | 792.93 | 793.04 |
| 255 | 992 | Ac-FTF$r8HYWAQL$S-NH2 | 1631.85 | 816.93 | 817.02 |
| 256 | 993 | Ac-WTF$r8HYWAQL$S-NH2 | 1670.86 | 836.43 | 836.85 |
| 257 | 994 | Ac-RTF$r8HYWAQL$S-NH2 | 1640.88 | 821.44 | 821.9 |
| 258 | 995 | Ac-KTF$r8HYWAQL$S-NH2 | 1612.88 | 807.44 | 807.91 |
| 259 | 996 | Ac-LNleF$r8HYWAQL$S-NH2 | 1609.90 | 805.95 | 806.43 |
| 260 | 997 | Ac-LVF$r8HYWAQL$S-NH2 | 1595.89 | 798.95 | 798.93 |
| 261 | 998 | Ac-LFF$r8HYWAQL$S-NH2 | 1643.89 | 822.95 | 823.38 |
| 262 | 999 | Ac-LWF$r8HYWAQL$S-NH2 | 1682.90 | 842.45 | 842.55 |
| 263 | 1000 | Ac-LRF$r8HYWAQL$S-NH2 | 1652.92 | 827.46 | 827.52 |
| 264 | 1001 | Ac-LKF$r8HYWAQL$S-NH2 | 1624.91 | 813.46 | 813.51 |
| 265 | 1002 | Ac-LTF$r8NleYWAQL$S-NH2 | 1573.89 | 787.95 | 788.05 |
| 266 | 1003 | Ac-LTF$r8VYWAQL$S-NH2 | 1559.88 | 780.94 | 780.98 |
| 267 | 1004 | Ac-LTF$r8FYWAQL$S-NH2 | 1607.88 | 804.94 | 805.32 |
| 268 | 1005 | Ac-LTF$r8WYWAQL$S-NH2 | 1646.89 | 824.45 | 824.86 |
| 269 | 1006 | Ac-LTF$r8RYWAQL$S-NH2 | 1616.91 | 809.46 | 809.51 |
| 270 | 1007 | Ac-LTF$r8KYWAQL$S-NH2 | 1588.90 | 795.45 | 795.48 |
| 271 | 1008 | Ac-LTF$r8HNleWAQL$S-NH2 | 1547.89 | 774.95 | 774.98 |
| 272 | 1009 | Ac-LTF$r8HVWAQL$S-NH2 | 1533.87 | 767.94 | 767.95 |
| 273 | 1010 | Ac-LTF$r8HFWAQL$S-NH2 | 1581.87 | 791.94 | 792.3 |
| 274 | 1011 | Ac-LTF$r8HWWAQL$S-NH2 | 1620.88 | 811.44 | 811.54 |

TABLE 2b-continued

| Number | SEQ ID NO: | Sequence | Exact Mass | M + 2 | Observed mass (m/e) |
|---|---|---|---|---|---|
| 275 | 1012 | Ac-LTF$r8HRWAQL$S-NH2 | 1590.90 | 796.45 | 796.52 |
| 276 | 1013 | Ac-LTF$r8HKWAQL$S-NH2 | 1562.90 | 782.45 | 782.53 |
| 277 | 1014 | Ac-LTF$r8HYWNleQL$S-NH2 | 1639.91 | 820.96 | 820.98 |
| 278 | 1015 | Ac-LTF$r8HYWVQL$S-NH2 | 1625.90 | 813.95 | 814.03 |
| 279 | 1016 | Ac-LTF$r8HYWFQL$S-NH2 | 1673.90 | 837.95 | 838.03 |
| 280 | 1017 | Ac-LTF$r8HYWWQL$S-NH2 | 1712.91 | 857.46 | 857.5 |
| 281 | 1018 | Ac-LTF$r8HYWKQL$S-NH2 | 1654.92 | 828.46 | 828.49 |
| 282 | 1019 | Ac-LTF$r8HYWANleL$S-NH2 | 1582.89 | 792.45 | 792.52 |
| 283 | 1020 | Ac-LTF$r8HYWAVL$S-NH2 | 1568.88 | 785.44 | 785.49 |
| 284 | 1021 | Ac-LTF$r8HYWAFL$S-NH2 | 1616.88 | 809.44 | 809.47 |
| 285 | 1022 | Ac-LTF$r8HYWAWL$S-NH2 | 1655.89 | 828.95 | 829 |
| 286 | 1023 | Ac-LTF$r8HYWARL$S-NH2 | 1625.91 | 813.96 | 813.98 |
| 287 | 1024 | Ac-LTF$r8HYWAQL$Nle-NH2 | 1623.92 | 812.96 | 813.39 |
| 288 | 1025 | Ac-LTF$r8HYWAQL$V-NH2 | 1609.90 | 805.95 | 805.99 |
| 289 | 1026 | Ac-LTF$r8HYWAQL$F-NH2 | 1657.90 | 829.95 | 830.26 |
| 290 | 1027 | Ac-LTF$r8HYWAQL$W-NH2 | 1696.91 | 849.46 | 849.5 |
| 291 | 1028 | Ac-LTF$r8HYWAQL$R-NH2 | 1666.94 | 834.47 | 834.56 |
| 292 | 1029 | Ac-LTF$r8HYWAQL$K-NH2 | 1638.93 | 820.47 | 820.49 |
| 293 | 1030 | Ac-Q$r8QQTFSN$WRLLAibQN-NH2 | 2080.12 | 1041.06 | 1041.54 |
| 294 | 1031 | Ac-QSQQ$r8FSNLWR$LAibQN-NH2 | 2066.11 | 1034.06 | 1034.58 |
| 295 | 1032 | Ac-LT2Pal$r8HYWAQL$S-NH2 | 1598.86 | 800.43 | 800.49 |
| 296 | 1033 | Ac-LT3Pal$r8HYWAQL$S-NH2 | 1598.86 | 800.43 | 800.49 |
| 297 | 1034 | Ac-LT4Pal$r8HYWAQL$S-NH2 | 1598.86 | 800.43 | 800.49 |
| 298 | 1035 | Ac-LTF2CF3$r8HYWAQL$S-NH2 | 1665.85 | 833.93 | 834.01 |
| 299 | 1036 | Ac-LTF2CNsr8HYWAQL$S-NH2 | 1622.86 | 812.43 | 812.47 |
| 300 | 1037 | Ac-LTF2Me$r8HYWAQL$S-NH2 | 1611.88 | 806.94 | 807 |
| 301 | 1038 | Ac-LTF3Cl$r8HYWAQL$S-NH2 | 1631.83 | 816.92 | 816.99 |
| 302 | 1039 | Ac-LTF4CF3$r8HYWAQL$S-NH2 | 1665.85 | 833.93 | 833.94 |
| 303 | 1040 | Ac-LTF4tBu$r8HYWAQL$S-NH2 | 1653.93 | 827.97 | 828.02 |
| 304 | 1041 | Ac-LTF5F$r8HYWAQL$S-NH2 | 1687.82 | 844.91 | 844.96 |
| 305 | 1042 | Ac-LTF$r8HY3BthAAQL$S-NH2 | 1614.83 | 808.42 | 808.48 |
| 306 | 1043 | Ac-LTF2Br$r8HYWAQL$S-NH2 | 1675.78 | 838.89 | 838.97 |
| 307 | 1044 | Ac-LTF4Br$r8HYWAQL$S-NH2 | 1675.78 | 838.89 | 839.86 |
| 308 | 1045 | Ac-LTF2Cl$r8HYWAQL$S-NH2 | 1631.83 | 816.92 | 816.99 |
| 309 | 1046 | Ac-LTF4Cl$r8HYWAQL$S-NH2 | 1631.83 | 816.92 | 817.36 |
| 310 | 1047 | Ac-LTF3CNsr8HYWAQL$S-NH2 | 1622.86 | 812.43 | 812.47 |
| 311 | 1048 | Ac-LTF4CNsr8HYWAQL$S-NH2 | 1622.86 | 812.43 | 812.47 |
| 312 | 1049 | Ac-LTF34Cl2$r8HYWAQL$S-NH2 | 1665.79 | 833.90 | 833.94 |

TABLE 2b-continued

| Number | SEQ ID NO: | Sequence | Exact Mass | M + 2 | Observed mass (m/e) |
|---|---|---|---|---|---|
| 313 | 1050 | Ac-LTF34F2$r8HYWAQL$S-NH2 | 1633.85 | 817.93 | 817.95 |
| 314 | 1051 | Ac-LTF35F2$r8HYWAQL$S-NH2 | 1633.85 | 817.93 | 817.95 |
| 315 | 1052 | Ac-LTDip$r8HYWAQL$S-NH2 | 1673.90 | 837.95 | 838.01 |
| 316 | 1053 | Ac-LTF2F$r8HYWAQL$S-NH2 | 1615.86 | 808.93 | 809 |
| 317 | 1054 | Ac-LTF3F$r8HYWAQL$S-NH2 | 1615.86 | 808.93 | 809 |
| 318 | 1055 | Ac-LTF4F$r8HYWAQL$S-NH2 | 1615.86 | 808.93 | 809 |
| 319 | 1056 | Ac-LTF4I$r8HYWAQL$S-NH2 | 1723.76 | 862.88 | 862.94 |
| 320 | 1057 | Ac-LTF3Me$r8HYWAQL$S-NH2 | 1611.88 | 806.94 | 807.07 |
| 321 | 1058 | Ac-LTF4Me$r8HYWAQL$S-NH2 | 1611.88 | 806.94 | 807 |
| 322 | 1059 | Ac-LT1Nal$r8HYWAQL$S-NH2 | 1647.88 | 824.94 | 824.98 |
| 323 | 1060 | Ac-LT2Nal$r8HYWAQL$S-NH2 | 1647.88 | 824.94 | 825.06 |
| 324 | 1061 | Ac-LTF3CF3$r8HYWAQL$S-NH2 | 1665.85 | 833.93 | 834.01 |
| 325 | 1062 | Ac-LTF4NO2Sr8HYWAQL$S-NH2 | 1642.85 | 822.43 | 822.46 |
| 326 | 1063 | Ac-LTF3NO2Sr8HYWAQL$S-NH2 | 1642.85 | 822.43 | 822.46 |
| 327 | 1064 | Ac-LTF$r82ThiYWAQL$S-NH2 | 1613.83 | 807.92 | 807.96 |
| 328 | 1065 | Ac-LTF$r8HBipWAQL$S-NH2 | 1657.90 | 829.95 | 830.01 |
| 329 | 1066 | Ac-LTF$r8HF4tBuWAQL$S-NH2 | 1637.93 | 819.97 | 820.02 |
| 330 | 1067 | Ac-LTF$r8HF4CF3WAQL$S-NH2 | 1649.86 | 825.93 | 826.02 |
| 331 | 1068 | Ac-LTF$r8HF4ClWAQL$S-NH2 | 1615.83 | 808.92 | 809.37 |
| 332 | 1069 | Ac-LTF$r8HF4MeWAQL$S-NH2 | 1595.89 | 798.95 | 799.01 |
| 333 | 1070 | Ac-LTF$r8HF4BrWAQL$S-NH2 | 1659.78 | 830.89 | 830.98 |
| 334 | 1071 | Ac-LTF$r8HF4CNWAQL$S-NH2 | 1606.87 | 804.44 | 804.56 |
| 335 | 1072 | Ac-LTF$r8HF4NO2WAQL$S-NH2 | 1626.86 | 814.43 | 814.55 |
| 336 | 1073 | Ac-LTF$r8H1NalWAQL$S-NH2 | 1631.89 | 816.95 | 817.06 |
| 337 | 1074 | Ac-LTF$r8H2NalWAQL$S-NH2 | 1631.89 | 816.95 | 816.99 |
| 338 | 1075 | Ac-LTF$r8HWAQL$S-NH2 | 1434.80 | 718.40 | 718.49 |
| 339 | 1076 | Ac-LTF$r8HY1NalAQL$S-NH2 | 1608.87 | 805.44 | 805.52 |
| 340 | 1077 | Ac-LTF$r8HY2NalAQL$S-NH2 | 1608.87 | 805.44 | 805.52 |
| 341 | 1078 | Ac-LTF$r8HYWAQI$S-NH2 | 1597.87 | 799.94 | 800.07 |
| 342 | 1079 | Ac-LTF$r8HYWAQNle$S-NH2 | 1597.87 | 799.94 | 800.44 |
| 343 | 1080 | Ac-LTF$er8HYWAQL$eA-NH2 | 1581.87 | 791.94 | 791.98 |
| 344 | 1081 | Ac-LTF$r8HYWAQL$Abu-NH2 | 1595.89 | 798.95 | 799.03 |
| 345 | 1082 | Ac-LTF$r8HYWAbuQ$S-NH2 | 1611.88 | 806.94 | 804.47 |
| 346 | 1083 | Ac-LAF$r8HYWAQL$S-NH2 | 1567.86 | 784.93 | 785.49 |
| 347 | 1084 | Ac-LTF$r8NLWANleL$Q-NH2 | 1550.92 | 776.46 | 777.5 |
| 348 | 1085 | Ac-LTF$r8ALWANleL$Q-NH2 | 1507.92 | 754.96 | 755.52 |
| 349 | 1086 | Ac-LAF$r8NLWANleL$Q-NH2 | 1520.91 | 761.46 | 762.48 |
| 350 | 1087 | Ac-F$r8AYWAAc3cL$A-NH2 | 1256.70 | 629.35 | 1257.56 |

TABLE 2b-continued

| Number | SEQ ID NO: | Sequence | Exact Mass | M + 2 | Observed mass (m/e) |
|---|---|---|---|---|---|
| 351 | 1088 | Ac-LTF$r8AYWAAL$S-NH2 | 1474.82 | 738.41 | 738.55 |
| 352 | 1089 | Ac-LVF$r8AYWAQL$S-NH2 | 1529.87 | 765.94 | 766 |
| 353 | 1090 | Ac-LTF$r8AYWAbuQL$S-NH2 | 1545.86 | 773.93 | 773.92 |
| 354 | 1091 | Ac-LTF$r8AYWNleQL$S-NH2 | 1573.89 | 787.95 | 788.17 |
| 355 | 1092 | Ac-LTF$r8AbuYWAQL$S-NH2 | 1545.86 | 773.93 | 773.99 |
| 356 | 1093 | Ac-LTF$r8AYWHQL$S-NH2 | 1597.87 | 799.94 | 799.97 |
| 357 | 1094 | Ac-LTF$r8AYWKQL$S-NH2 | 1588.90 | 795.45 | 795.53 |
| 358 | 1095 | Ac-LTF$r8AYWOQL$S-NH2 | 1574.89 | 788.45 | 788.5 |
| 359 | 1096 | Ac-LTF$r8AYWRQL$S-NH2 | 1616.91 | 809.46 | 809.51 |
| 360 | 1097 | Ac-LTF$r8AYWSQL$S-NH2 | 1547.84 | 774.92 | 774.96 |
| 361 | 1098 | Ac-LTF$r8AYWRAL$S-NH2 | 1559.89 | 780.95 | 780.95 |
| 362 | 1099 | Ac-LTF$r8AYWRQL$A-NH2 | 1600.91 | 801.46 | 801.52 |
| 363 | 1100 | Ac-LTF$r8AYWRAL$A-NH2 | 1543.89 | 772.95 | 773.03 |
| 364 | 1101 | Ac-LTF$r5HYWAQL$s8S-NH2 | 1597.87 | 799.94 | 799.97 |
| 365 | 1102 | Ac-LTF$HYWAQL$r8S-NH2 | 1597.87 | 799.94 | 799.97 |
| 366 | 1103 | Ac-LTF$r8HYWAAL$S-NH2 | 1540.84 | 771.42 | 771.48 |
| 367 | 1104 | Ac-LTF$r8HYWAAbuL$S-NH2 | 1554.86 | 778.43 | 778.51 |
| 368 | 1105 | Ac-LTF$r8HYWALL$S-NH2 | 1582.89 | 792.45 | 792.49 |
| 369 | 1106 | Ac-F$r8AYWHAL$A-NH2 | 1310.72 | 656.36 | 656.4 |
| 370 | 1107 | Ac-F$r8AYWAAL$A-NH2 | 1244.70 | 623.35 | 1245.61 |
| 371 | 1108 | Ac-F$r8AYWSAL$A-NH2 | 1260.69 | 631.35 | 1261.6 |
| 372 | 1109 | Ac-F$r8AYWRAL$A-NH2 | 1329.76 | 665.88 | 1330.72 |
| 373 | 1110 | Ac-F$r8AYWKAL$A-NH2 | 1301.75 | 651.88 | 1302.67 |
| 374 | 1111 | Ac-F$r8AYWOAL$A-NH2 | 1287.74 | 644.87 | 1289.13 |
| 375 | 1112 | Ac-F$r8VYWEAc3cL$A-NH2 | 1342.73 | 672.37 | 1343.67 |
| 376 | 1113 | Ac-F$r8FYWEAc3cL$A-NH2 | 1390.73 | 696.37 | 1392.14 |
| 377 | 1114 | Ac-F$r8WYWEAc3cL$A-NH2 | 1429.74 | 715.87 | 1431.44 |
| 378 | 1115 | Ac-F$r8RYWEAc3cL$A-NH2 | 1399.77 | 700.89 | 700.95 |
| 379 | 1116 | Ac-F$r8KYWEAc3cL$A-NH2 | 1371.76 | 686.88 | 686.97 |
| 380 | 1117 | Ac-F$r8ANleWEAc3cL$A-NH2 | 1264.72 | 633.36 | 1265.59 |
| 381 | 1118 | Ac-F$r8AVWEAc3cL$A-NH2 | 1250.71 | 626.36 | 1252.2 |
| 382 | 1119 | Ac-F$r8AFWEAc3cL$A-NH2 | 1298.71 | 650.36 | 1299.64 |
| 383 | 1120 | Ac-F$r8AWWEAc3cL$A-NH2 | 1337.72 | 669.86 | 1338.64 |
| 384 | 1121 | Ac-F$r8ARWEAc3cL$A-NH2 | 1307.74 | 654.87 | 655 |
| 385 | 1122 | Ac-F$r8AKWEAc3cL$A-NH2 | 1279.73 | 640.87 | 641.01 |
| 386 | 1123 | Ac-F$r8AYWVAc3cL$A-NH2 | 1284.73 | 643.37 | 643.38 |
| 387 | 1124 | Ac-F$r8AYWFAc3cL$A-NH2 | 1332.73 | 667.37 | 667.43 |
| 388 | 1125 | Ac-F$r8AYWWAc3cL$A-NH2 | 1371.74 | 686.87 | 686.97 |

TABLE 2b-continued

| Number | SEQ ID NO: | Sequence | Exact Mass | M + 2 | Observed mass (m/e) |
|---|---|---|---|---|---|
| 389 | 1126 | Ac-F$r8AYWRAc3cL$A-NH2 | 1341.76 | 671.88 | 671.94 |
| 390 | 1127 | Ac-F$r8AYWKAc3cL$A-NH2 | 1313.75 | 657.88 | 657.88 |
| 391 | 1128 | Ac-F$r8AYWEVL$A-NH2 | 1330.73 | 666.37 | 666.47 |
| 392 | 1129 | Ac-F$r8AYWEFL$A-NH2 | 1378.73 | 690.37 | 690.44 |
| 393 | 1130 | Ac-F$r8AYWEWL$A-NH2 | 1417.74 | 709.87 | 709.91 |
| 394 | 1131 | Ac-F$r8AYWERL$A-NH2 | 1387.77 | 694.89 | 1388.66 |
| 395 | 1132 | Ac-F$r8AYWEKL$A-NH2 | 1359.76 | 680.88 | 1361.21 |
| 396 | 1133 | Ac-F$r8AYWEAc3cL$V-NH2 | 1342.73 | 672.37 | 1343.59 |
| 397 | 1134 | Ac-F$r8AYWEAc3cL$F-NH2 | 1390.73 | 696.37 | 1392.58 |
| 398 | 1135 | Ac-F$r8AYWEAc3cL$W-NH2 | 1429.74 | 715.87 | 1431.29 |
| 399 | 1136 | Ac-F$r8AYWEAc3cL$R-NH2 | 1399.77 | 700.89 | 700.95 |
| 400 | 1137 | Ac-F$r8AYWEAc3cL$K-NH2 | 1371.76 | 686.88 | 686.97 |
| 401 | 1138 | Ac-F$r8AYWEAc3cL$AV-NH2 | 1413.77 | 707.89 | 707.91 |
| 402 | 1139 | Ac-F$r8AYWEAc3cL$AF-NH2 | 1461.77 | 731.89 | 731.96 |
| 403 | 1140 | Ac-F$r8AYWEAc3cL$AW-NH2 | 1500.78 | 751.39 | 751.5 |
| 404 | 1141 | Ac-F$r8AYWEAc3cL$AR-NH2 | 1470.80 | 736.40 | 736.47 |
| 405 | 1142 | Ac-F$r8AYWEAc3cL$AK-NH2 | 1442.80 | 722.40 | 722.41 |
| 406 | 1143 | Ac-F$r8AYWEAc3cL$AH-NH2 | 1451.76 | 726.88 | 726.93 |
| 407 | 1144 | Ac-LTF2NO2$r8HYWAQL$S-NH2 | 1642.85 | 822.43 | 822.54 |
| 408 | 1145 | Ac-LTA$r8HYAAQL$S-NH2 | 1406.79 | 704.40 | 704.5 |
| 409 | 1146 | Ac-LTF$r8HYAAQL$S-NH2 | 1482.82 | 742.41 | 742.47 |
| 410 | 1147 | Ac-QSQQTF$r8NLWALL$AN-NH2 | 1966.07 | 984.04 | 984.38 |
| 411 | 1148 | Ac-QAibQQTF$r8NLWALL$AN-NH2 | 1964.09 | 983.05 | 983.42 |
| 412 | 1149 | Ac-QAibQQTF$r8ALWALL$AN-NH2 | 1921.08 | 961.54 | 961.59 |
| 413 | 1150 | Ac-AAAATF$r8AAWAAL$AA-NH2 | 1608.90 | 805.45 | 805.52 |
| 414 | 1151 | Ac-F$r8AAWRAL$Q-NH2 | 1294.76 | 648.38 | 648.48 |
| 415 | 1152 | Ac-TF$r8AAWAAL$Q-NH2 | 1310.74 | 656.37 | 1311.62 |
| 416 | 1153 | Ac-TF$r8AAWRAL$A-NH2 | 1338.78 | 670.39 | 670.46 |
| 417 | 1154 | Ac-VF$r8AAWRAL$Q-NH2 | 1393.82 | 697.91 | 697.99 |
| 418 | 1155 | Ac-AF$r8AAWAAL$A-NH2 | 1223.71 | 612.86 | 1224.67 |
| 420 | 1156 | Ac-TF$r8AAWKAL$Q-NH2 | 1367.80 | 684.90 | 684.97 |
| 421 | 1157 | Ac-TF$r8AAWOAL$Q-NH2 | 1353.78 | 677.89 | 678.01 |
| 422 | 1158 | Ac-TF$r8AAWSAL$Q-NH2 | 1326.73 | 664.37 | 664.47 |
| 423 | 1159 | Ac-LTF$r8AAWRAL$Q-NH2 | 1508.89 | 755.45 | 755.49 |
| 424 | 1160 | Ac-F$r8AYWAQL$A-NH2 | 1301.72 | 651.86 | 651.96 |
| 425 | 1161 | Ac-F$r8AWWAAL$A-NH2 | 1267.71 | 634.86 | 634.87 |
| 426 | 1162 | Ac-F$r8AWWAQL$A-NH2 | 1324.73 | 663.37 | 663.43 |
| 427 | 1163 | Ac-F$r8AYWEAL$-NH2 | 1231.66 | 616.83 | 1232.93 |

TABLE 2b-continued

| Number | SEQ ID NO: | Sequence | Exact Mass | M + 2 | Observed mass (m/e) |
|---|---|---|---|---|---|
| 428 | 1164 | Ac-F$r8AYWAAL$-NH2 | 1173.66 | 587.83 | 1175.09 |
| 429 | 1165 | Ac-F$r8AYWKAL$-NH2 | 1230.72 | 616.36 | 616.44 |
| 430 | 1166 | Ac-F$r8AYWOAL$-NH2 | 1216.70 | 609.35 | 609.48 |
| 431 | 1167 | Ac-F$r8AYWQAL$-NH2 | 1230.68 | 616.34 | 616.44 |
| 432 | 1168 | Ac-F$r8AYWAQL$-NH2 | 1230.68 | 616.34 | 616.37 |
| 433 | 1169 | Ac-F$r8HYWDQL$S-NH2 | 1427.72 | 714.86 | 714.86 |
| 434 | 1170 | Ac-F$r8HFWEQL$S-NH2 | 1425.74 | 713.87 | 713.98 |
| 435 | 1171 | Ac-F$r8AYWHQL$S-NH2 | 1383.73 | 692.87 | 692.96 |
| 436 | 1172 | Ac-F$r8AYWKQL$S-NH2 | 1374.77 | 688.39 | 688.45 |
| 437 | 1173 | Ac-F$r8AYWOQL$S-NH2 | 1360.75 | 681.38 | 681.49 |
| 438 | 1174 | Ac-F$r8HYWSQL$S-NH2 | 1399.73 | 700.87 | 700.95 |
| 439 | 1175 | Ac-F$r8HWWEQL$S-NH2 | 1464.76 | 733.38 | 733.44 |
| 440 | 1176 | Ac-F$r8HWWAQL$S-NH2 | 1406.75 | 704.38 | 704.43 |
| 441 | 1177 | Ac-F$r8AWWHQL$S-NH2 | 1406.75 | 704.38 | 704.43 |
| 442 | 1178 | Ac-F$r8AWWKQL$S-NH2 | 1397.79 | 699.90 | 699.92 |
| 443 | 1179 | Ac-F$r8AWWOQL$S-NH2 | 1383.77 | 692.89 | 692.96 |
| 444 | 1180 | Ac-F$r8HWWSQL$S-NH2 | 1422.75 | 712.38 | 712.42 |
| 445 | 1181 | Ac-LTF$r8NYWAN1eL$Q-NH2 | 1600.90 | 801.45 | 801.52 |
| 446 | 1182 | Ac-LTF$r8NLWAQL$Q-NH2 | 1565.90 | 783.95 | 784.06 |
| 447 | 1183 | Ac-LTF$r8NYWAN1eL$A-NH2 | 1543.88 | 772.94 | 773.03 |
| 448 | 1184 | Ac-LTF$r8NLWAQL$A-NH2 | 1508.88 | 755.44 | 755.49 |
| 449 | 1185 | Ac-LTF$r8AYWAN1eL$Q-NH2 | 1557.90 | 779.95 | 780.06 |
| 450 | 1186 | Ac-LTF$r8ALWAQL$Q-NH2 | 1522.89 | 762.45 | 762.45 |
| 451 | 1187 | Ac-LAF$r8NYWAN1eL$Q-NH2 | 1570.89 | 786.45 | 786.5 |
| 452 | 1188 | Ac-LAF$r8NLWAQL$Q-NH2 | 1535.89 | 768.95 | 769.03 |
| 453 | 1189 | Ac-LAF$r8AYWAN1eL$A-NH2 | 1470.86 | 736.43 | 736.47 |
| 454 | 1190 | Ac-LAF$r8ALWAQL$A-NH2 | 1435.86 | 718.93 | 719.01 |
| 455 | 1191 | Ac-LAF$r8AYWAAL$A-NH2 | 1428.82 | 715.41 | 715.41 |
| 456 | 1192 | Ac-F$r8AYWEAc3cL$AAib-NH2 | 1399.75 | 700.88 | 700.95 |
| 457 | 1193 | Ac-F$r8AYWAQL$AA-NH2 | 1372.75 | 687.38 | 687.78 |
| 458 | 1194 | Ac-F$r8AYWAAc3cL$AA-NH2 | 1327.73 | 664.87 | 664.84 |
| 459 | 1195 | Ac-F$r8AYWSAc3cL$AA-NH2 | 1343.73 | 672.87 | 672.9 |
| 460 | 1196 | Ac-F$r8AYWEAc3cL$AS-NH2 | 1401.73 | 701.87 | 701.84 |
| 461 | 1197 | Ac-F$r8AYWEAc3cL$AT-NH2 | 1415.75 | 708.88 | 708.87 |
| 462 | 1198 | Ac-F$r8AYWEAc3cL$AL-NH2 | 1427.79 | 714.90 | 714.94 |
| 463 | 1199 | Ac-F$r8AYWEAc3cL$AQ-NH2 | 1442.76 | 722.38 | 722.41 |
| 464 | 1200 | Ac-F$r8AFWEAc3cL$AA-NH2 | 1369.74 | 685.87 | 685.93 |
| 465 | 1201 | Ac-F$r8AWWEAc3cL$AA-NH2 | 1408.75 | 705.38 | 705.39 |

TABLE 2b-continued

| Number | SEQ ID NO: | Sequence | Exact Mass | M + 2 | Observed mass (m/e) |
|---|---|---|---|---|---|
| 466 | 1202 | Ac-F$r8AYWEAc3cL$SA-NH2 | 1401.73 | 701.87 | 701.99 |
| 467 | 1203 | Ac-F$r8AYWEAL$AA-NH2 | 1373.74 | 687.87 | 687.93 |
| 468 | 1204 | Ac-F$r8AYWENleL$AA-NH2 | 1415.79 | 708.90 | 708.94 |
| 469 | 1205 | Ac-F$r8AYWEAc3cL$AbuA-NH2 | 1399.75 | 700.88 | 700.95 |
| 470 | 1206 | Ac-F$r8AYWEAc3cL$NleA-NH2 | 1427.79 | 714.90 | 714.86 |
| 471 | 1207 | Ac-F$r8AYWEAibL$NleA-NH2 | 1429.80 | 715.90 | 715.97 |
| 472 | 1208 | Ac-F$r8AYWEAL$NleA-NH2 | 1415.79 | 708.90 | 708.94 |
| 473 | 1209 | Ac-F$r8AYWENleL$NleA-NH2 | 1457.83 | 729.92 | 729.96 |
| 474 | 1210 | Ac-F$r8AYWEAibL$Abu-NH2 | 1330.73 | 666.37 | 666.39 |
| 475 | 1211 | Ac-F$r8AYWENleLSAbu-NH2 | 1358.76 | 680.38 | 680.39 |
| 476 | 1212 | Ac-F$r8AYWEAL$Abu-NH2 | 1316.72 | 659.36 | 659.36 |
| 477 | 1213 | Ac-LTF$r8AFWAQL$S-NH2 | 1515.85 | 758.93 | 759.12 |
| 478 | 1214 | Ac-LTF$r8AWWAQL$S-NH2 | 1554.86 | 778.43 | 778.51 |
| 479 | 1215 | Ac-LTF$r8AYWAQI$S-NH2 | 1531.84 | 766.92 | 766.96 |
| 480 | 1216 | Ac-LTF$r8AYWAQNle$S-NH2 | 1531.84 | 766.92 | 766.96 |
| 481 | 1217 | Ac-LTF$r8AYWAQL$SA-NH2 | 1602.88 | 802.44 | 802.48 |
| 482 | 1218 | Ac-LTF$r8AWWAQL$A-NH2 | 1538.87 | 770.44 | 770.89 |
| 483 | 1219 | Ac-LTF$r8AYWAQI$A-NH2 | 1515.85 | 758.93 | 759.42 |
| 484 | 1220 | Ac-LTF$r8AYWAQNle$A-NH2 | 1515.85 | 758.93 | 759.42 |
| 485 | 1221 | Ac-LTF$r8AYWAQL$AA-NH2 | 1586.89 | 794.45 | 794.94 |
| 486 | 1222 | Ac-LTF$r8HWWAQL$S-NH2 | 1620.88 | 811.44 | 811.47 |
| 487 | 1223 | Ac-LTF$r8HRWAQL$S-NH2 | 1590.90 | 796.45 | 796.52 |
| 488 | 1224 | Ac-LTF$r8HKWAQL$S-NH2 | 1562.90 | 782.45 | 782.53 |
| 489 | 1225 | Ac-LTF$r8HYWAQL$W-NH2 | 1696.91 | 849.46 | 849.5 |
| 491 | 1226 | Ac-F$r8AYWAbuAL$A-NH2 | 1258.71 | 630.36 | 630.5 |
| 492 | 1227 | Ac-F$r8AbuYWEAL$A-NH2 | 1316.72 | 659.36 | 659.51 |
| 493 | 1228 | Ac-NlePRF%r8NYWRLL%QN-NH2 | 1954.13 | 978.07 | 978.54 |
| 494 | 1229 | Ac-TSF%r8HYWAQL%S-NH2 | 1573.83 | 787.92 | 787.98 |
| 495 | 1230 | Ac-LTF%r8AYWAQL%S-NH2 | 1533.86 | 767.93 | 768 |
| 496 | 1231 | Ac-HTF$r8HYWAQL$S-NH2 | 1621.84 | 811.92 | 811.96 |
| 497 | 1232 | Ac-LHF$r8HYWAQL$S-NH2 | 1633.88 | 817.94 | 818.02 |
| 498 | 1233 | Ac-LTF$r8HHWAQL$S-NH2 | 1571.86 | 786.93 | 786.94 |
| 499 | 1234 | Ac-LTF$r8HYWHQL$S-NH2 | 1663.89 | 832.95 | 832.38 |
| 500 | 1235 | Ac-LTF$r8HYWAHL$S-NH2 | 1606.87 | 804.44 | 804.48 |
| 501 | 1236 | Ac-LTF$r8HYWAQL$H-NH2 | 1647.89 | 824.95 | 824.98 |
| 502 | 1237 | Ac-LTF$r8HYWAQL$S-NHPr | 1639.91 | 820.96 | 820.98 |
| 503 | 1238 | Ac-LTF$r8HYWAQL$S-NHsBu | 1653.93 | 827.97 | 828.02 |
| 504 | 1239 | Ac-LTF$r8HYWAQL$S-NHiBu | 1653.93 | 827.97 | 828.02 |

TABLE 2b-continued

| Number | SEQ ID NO: | Sequence | Exact Mass | M + 2 | Observed mass (m/e) |
|---|---|---|---|---|---|
| 505 | 1240 | Ac-LTF$r8HYWAQL$S-NHBn | 1687.91 | 844.96 | 844.44 |
| 506 | 1241 | Ac-LTF$r8HYWAQL$S-NHPe | 1700.92 | 851.46 | 851.99 |
| 507 | 1242 | Ac-LTF$r8HYWAQL$S-NHChx | 1679.94 | 840.97 | 841.04 |
| 508 | 1243 | Ac-ETF$r8AYWAQL$S-NH2 | 1547.80 | 774.90 | 774.96 |
| 509 | 1244 | Ac-STF$r8AYWAQL$S-NH2 | 1505.79 | 753.90 | 753.94 |
| 510 | 1245 | Ac-LEF$r8AYWAQL$S-NH2 | 1559.84 | 780.92 | 781.25 |
| 511 | 1246 | Ac-LSF$r8AYWAQL$S-NH2 | 1517.83 | 759.92 | 759.93 |
| 512 | 1247 | Ac-LTF$r8EYWAQL$S-NH2 | 1589.85 | 795.93 | 795.97 |
| 513 | 1248 | Ac-LTF$r8SYWAQL$S-NH2 | 1547.84 | 774.92 | 774.96 |
| 514 | 1249 | Ac-LTF$r8AYWEQL$S-NH2 | 1589.85 | 795.93 | 795.9 |
| 515 | 1250 | Ac-LTF$r8AYWAEL$S-NH2 | 1532.83 | 767.42 | 766.96 |
| 516 | 1251 | Ac-LTF$r8AYWASL$S-NH2 | 1490.82 | 746.41 | 746.46 |
| 517 | 1252 | Ac-LTF$r8AYWAQL$E-NH2 | 1573.85 | 787.93 | 787.98 |
| 518 | 1253 | Ac-LTF2CN$r8HYWAQL$S-NH2 | 1622.86 | 812.43 | 812.47 |
| 519 | 1254 | Ac-LTF3Cl$r8HYWAQL$S-NH2 | 1631.83 | 816.92 | 816.99 |
| 520 | 1255 | Ac-LTDip$r8HYWAQL$S-NH2 | 1673.90 | 837.95 | 838.01 |
| 521 | 1256 | Ac-LTF$r8HYWAQTle$S-NH2 | 1597.87 | 799.94 | 800.04 |
| 522 | 1257 | Ac-F$r8AY6clWEAL$A-NH2 | 1336.66 | 669.33 | 1338.56 |
| 523 | 1258 | Ac-F$r8AYd16brWEAL$A-NH2 | 1380.61 | 691.31 | 692.2 |
| 524 | 1259 | Ac-F$r8AYd16fWEAL$A-NH2 | 1320.69 | 661.35 | 1321.61 |
| 525 | 1260 | Ac-F$r8AYd14mWEAL$A-NH2 | 1316.72 | 659.36 | 659.36 |
| 526 | 1261 | Ac-F$r8AYd15clWEAL$A-NH2 | 1336.66 | 669.33 | 669.35 |
| 527 | 1262 | Ac-F$r8AYd17mWEAL$A-NH2 | 1316.72 | 659.36 | 659.36 |
| 528 | 1263 | Ac-LTF%r8HYWAQL%A-NH2 | 1583.89 | 792.95 | 793.01 |
| 529 | 1264 | Ac-LTF$r8HCouWAQL$S-NH2 | 1679.87 | 840.94 | 841.38 |
| 530 | 1265 | Ac-LTFEHCouWAQLTS-NH2 | 1617.75 | 809.88 | 809.96 |
| 531 | 1266 | Ac-LTA$r8HCouWAQL$S-NH2 | 1603.84 | 802.92 | 803.36 |
| 532 | 1267 | Ac-F$r8AYWEAL$AbuA-NH2 | 1387.75 | 694.88 | 694.88 |
| 533 | 1268 | Ac-F$r8AYWEAI$AA-NH2 | 1373.74 | 687.87 | 687.93 |
| 534 | 1269 | Ac-F$r8AYWEANle$AA-NH2 | 1373.74 | 687.87 | 687.93 |
| 535 | 1270 | Ac-F$r8AYWEAmlL$AA-NH2 | 1429.80 | 715.90 | 715.97 |
| 536 | 1271 | Ac-F$r8AYWQAL$AA-NH2 | 1372.75 | 687.38 | 687.48 |
| 537 | 1272 | Ac-F$r8AYWAAL$AA-NH2 | 1315.73 | 658.87 | 658.92 |
| 538 | 1273 | Ac-F$r8AYWAbuAL$AA-NH2 | 1329.75 | 665.88 | 665.95 |
| 539 | 1274 | Ac-FSr8AYWNleAL$AA-NH2 | 1357.78 | 679.89 | 679.94 |
| 540 | 1275 | Ac-F$r8AbuYWEAL$AA-NH2 | 1387.75 | 694.88 | 694.96 |
| 541 | 1276 | Ac-FSr8NleYWEAL$AA-NH2 | 1415.79 | 708.90 | 708.94 |
| 542 | 1277 | Ac-F$r8FYWEAL$AA-NH2 | 1449.77 | 725.89 | 725.97 |

TABLE 2b-continued

| Number | SEQ ID NO: | Sequence | Exact Mass | M + 2 | Observed mass (m/e) |
|---|---|---|---|---|---|
| 543 | 1278 | Ac-LTF$r8HYWAQhL$S-NH2 | 1611.88 | 806.94 | 807 |
| 544 | 1279 | Ac-LTF$r8HYWAQAdm$S-NH2 | 1675.91 | 838.96 | 839.04 |
| 545 | 1280 | Ac-LTF$r8HYWAQIgl$S-NH2 | 1659.88 | 830.94 | 829.94 |
| 546 | 1281 | Ac-F$r8AYWAQL$AA-NH2 | 1372.75 | 687.38 | 687.48 |
| 547 | 1282 | Ac-LTF$r8ALWAQL$Q-NH2 | 1522.89 | 762.45 | 762.52 |
| 548 | 1283 | Ac-F$r8AYWEAL$AA-NH2 | 1373.74 | 687.87 | 687.93 |
| 549 | 1284 | Ac-F$r8AYWENleL$AA-NH2 | 1415.79 | 708.90 | 708.94 |
| 550 | 1285 | Ac-F$r8AYWEAibL$Abu-NH2 | 1330.73 | 666.37 | 666.39 |
| 551 | 1286 | Ac-F$r8AYWENleLSAbu-NH2 | 1358.76 | 680.38 | 680.38 |
| 552 | 1287 | Ac-F$r8AYWEAL$Abu-NH2 | 1316.72 | 659.36 | 659.36 |
| 553 | 1288 | Ac-F$r8AYWEAc3cL$AbuA-NH2 | 1399.75 | 700.88 | 700.95 |
| 554 | 1289 | Ac-F$r8AYWEAc3cL$NleA-NH2 | 1427.79 | 714.90 | 715.01 |
| 555 | 1290 | H-LTF$r8AYWAQL$S-NH2 | 1489.83 | 745.92 | 745.95 |
| 556 | 1291 | mdPEG3-LTF$r8AYWAQL$S-NH2 | 1679.92 | 840.96 | 840.97 |
| 557 | 1292 | mdPEG7-LTF$r8AYWAQL$S-NH2 | 1856.02 | 929.01 | 929.03 |
| 558 | 1293 | Ac-F$r8ApmpEt6clWEAL$A-NH2 | 1470.71 | 736.36 | 788.17 |
| 559 | 1294 | Ac-LTF3Cl$r8AYWAQL$S-NH2 | 1565.81 | 783.91 | 809.18 |
| 560 | 1295 | Ac-LTF3Cl$r8HYWAQL$A-NH2 | 1615.83 | 808.92 | 875.24 |
| 561 | 1296 | Ac-LTF3Cl$r8HYWWQL$S-NH2 | 1746.87 | 874.44 | 841.65 |
| 562 | 1297 | Ac-LTF3Cl$r8AYWWQL$S-NH2 | 1680.85 | 841.43 | 824.63 |
| 563 | 1298 | Ac-LTF$r8AYWWQL$S-NH2 | 1646.89 | 824.45 | 849.98 |
| 564 | 1299 | Ac-LTF$r8HYWWQL$A-NH2 | 1696.91 | 849.46 | 816.67 |
| 565 | 1300 | Ac-LTF$r8AYWWQL$A-NH2 | 1630.89 | 816.45 | 776.15 |
| 566 | 1301 | Ac-LTF4F$r8AYWAQL$S-NH2 | 1549.83 | 775.92 | 776.15 |
| 567 | 1302 | Ac-LTF2F$r8AYWAQL$S-NH2 | 1549.83 | 775.92 | 776.15 |
| 568 | 1303 | Ac-LTF3F$r8AYWAQL$S-NH2 | 1549.83 | 775.92 | 785.12 |
| 569 | 1304 | Ac-LTF34F2$r8AYWAQL$S-NH2 | 1567.83 | 784.92 | 785.12 |
| 570 | 1305 | Ac-LTF35F2$r8AYWAQL$S-NH2 | 1567.83 | 784.92 | 1338.74 |
| 571 | 1306 | Ac-F3Cl$r8AYWEAL$A-NH2 | 1336.66 | 669.33 | 705.28 |
| 572 | 1307 | Ac-F3Cl$r8AYWEAL$AA-NH2 | 1407.70 | 704.85 | 680.11 |
| 573 | 1308 | Ac-F$r8AY6clWEAL$AA-NH2 | 1407.70 | 704.85 | 736.83 |
| 574 | 1309 | Ac-F$r8AY6clWEAL$-NH2 | 1265.63 | 633.82 | 784.1 |
| 575 | 1310 | Ac-LTF$r8HYWAQLSt/S-NH2 | 16.03 | 9.02 | 826.98 |
| 576 | 1311 | Ac-LTF$r8HYWAQL$S-NHsBu | 1653.93 | 827.97 | 828.02 |
| 577 | 1312 | Ac-STF$r8AYWAQL$S-NH2 | 1505.79 | 753.90 | 753.94 |
| 578 | 1313 | Ac-LTF$r8AYWAEL$S-NH2 | 1532.83 | 767.42 | 767.41 |
| 579 | 1314 | Ac-LTF$r8AYWAQL$E-NH2 | 1573.85 | 787.93 | 787.98 |
| 580 | 1315 | mdPEG3-LTF$r8AYWAQL$S-NH2 | 1679.92 | 840.96 | 840.97 |

TABLE 2b-continued

| Number | SEQ ID NO: | Sequence | Exact Mass | M + 2 | Observed mass (m/e) |
|---|---|---|---|---|---|
| 581 | 1316 | Ac-LTF$r8AYWAQhL$S-NH2 | 1545.86 | 773.93 | 774.31 |
| 583 | 1317 | Ac-LTF$r8AYWAQCha$S-NH2 | 1571.88 | 786.94 | 787.3 |
| 584 | 1318 | Ac-LTF$r8AYWAQChg$S-NH2 | 1557.86 | 779.93 | 780.4 |
| 585 | 1319 | Ac-LTF$r8AYWAQCba$S-NH2 | 1543.84 | 772.92 | 780.13 |
| 586 | 1320 | Ac-LTF$r8AYWAQF$S-NH2 | 1565.83 | 783.92 | 784.2 |
| 587 | 1321 | Ac-LTF4F$r8HYWAQhL$S-NH2 | 1629.87 | 815.94 | 815.36 |
| 588 | 1322 | Ac-LTF4F$r8HYWAQCha$S-NH2 | 1655.89 | 828.95 | 828.39 |
| 589 | 1323 | Ac-LTF4F$r8HYWAQChg$S-NH2 | 1641.87 | 821.94 | 821.35 |
| 590 | 1324 | Ac-LTF4F$r8HYWAQCba$S-NH2 | 1627.86 | 814.93 | 814.32 |
| 591 | 1325 | Ac-LTF4F$r8AYWAQhL$S-NH2 | 1563.85 | 782.93 | 782.36 |
| 592 | 1326 | Ac-LTF4F$r8AYWAQCha$S-NH2 | 1589.87 | 795.94 | 795.38 |
| 593 | 1327 | Ac-LTF4F$r8AYWAQChg$S-NH2 | 1575.85 | 788.93 | 788.35 |
| 594 | 1328 | Ac-LTF4F$r8AYWAQCba$S-NH2 | 1561.83 | 781.92 | 781.39 |
| 595 | 1329 | Ac-LTF3Cl$r8AYWAQhL$S-NH2 | 1579.82 | 790.91 | 790.35 |
| 596 | 1330 | Ac-LTF3Cl$r8AYWAQCha$S-NH2 | 1605.84 | 803.92 | 803.67 |
| 597 | 1331 | Ac-LTF3Cl$r8AYWAQChg$S-NH2 | 1591.82 | 796.91 | 796.34 |
| 598 | 1332 | Ac-LTF3Cl$r8AYWAQCba$S-NH2 | 1577.81 | 789.91 | 789.39 |
| 599 | 1333 | Ac-LTF$r8AYWAQhF$S-NH2 | 1579.84 | 790.92 | 791.14 |
| 600 | 1334 | Ac-LTF$r8AYWAQF3CF3$S-NH2 | 1633.82 | 817.91 | 818.15 |
| 601 | 1335 | Ac-LTF$r8AYWAQF3Me$S-NH2 | 1581.86 | 791.93 | 791.32 |
| 602 | 1336 | Ac-LTF$r8AYWAQ1Nal$S-NH2 | 1615.84 | 808.92 | 809.18 |
| 603 | 1337 | Ac-LTF$r8AYWAQBip$S-NH2 | 1641.86 | 821.93 | 822.13 |
| 604 | 1338 | Ac-LTF$r8FYWAQL$A-NH2 | 1591.88 | 796.94 | 797.33 |
| 605 | 1339 | Ac-LTF$r8HYWAQL$S-NHAm | 1667.94 | 834.97 | 835.92 |
| 606 | 1340 | Ac-LTF$r8HYWAQL$S-NHiAm | 1667.94 | 834.97 | 835.55 |
| 607 | 1341 | Ac-LTF$r8HYWAQL$S-NHnPr3Ph | 1715.94 | 858.97 | 859.79 |
| 608 | 1342 | Ac-LTF$r8HYWAQL$S-NHnBu3,3Me | 1681.96 | 841.98 | 842.49 |
| 610 | 1343 | Ac-LTF$r8HYWAQL$S-NHnPr | 1639.91 | 820.96 | 821.58 |
| 611 | 1344 | Ac-LTF$r8HYWAQL$S-NHnEt2Ch | 1707.98 | 854.99 | 855.35 |
| 612 | 1345 | Ac-LTF$r8HYWAQL$S-NHHex | 1681.96 | 841.98 | 842.4 |
| 613 | 1346 | Ac-LTF$r8AYWAQL$S-NHmdPeg2 | 1633.91 | 817.96 | 818.35 |
| 614 | 1347 | Ac-LTF$r8AYWAQL$A-NHmdPeg2 | 1617.92 | 809.96 | 810.3 |
| 615 | 1348 | Ac-LTF$r8AYWAQL$A-NHmdPeg4 | 1705.97 | 853.99 | 854.33 |
| 616 | 1349 | Ac-F$r8AYd14mWEAL$A-NH2 | 1316.72 | 659.36 | 659.44 |
| 617 | 1350 | Ac-F$r8AYd15clWEAL$A-NH2 | 1336.66 | 669.33 | 669.43 |
| 618 | 1351 | Ac-LThF$r8AYWAQL$S-NH2 | 1545.86 | 773.93 | 774.11 |
| 619 | 1352 | Ac-LT2Nal$r8AYWAQL$S-NH2 | 1581.86 | 791.93 | 792.43 |
| 620 | 1353 | Ac-LTA$r8AYWAQL$S-NH2 | 1455.81 | 728.91 | 729.15 |

TABLE 2b-continued

| Number | SEQ ID NO: | Sequence | Exact Mass | M + 2 | Observed mass (m/e) |
|---|---|---|---|---|---|
| 621 | 1354 | Ac-LTF$r8AYWVQL$S-NH2 | 1559.88 | 780.94 | 781.24 |
| 622 | 1355 | Ac-LTF$r8HYWAAL$A-NH2 | 1524.85 | 763.43 | 763.86 |
| 623 | 1356 | Ac-LTF$r8VYWAQL$A-NH2 | 1543.88 | 772.94 | 773.37 |
| 624 | 1357 | Ac-LTF$r8IYWAQL$S-NH2 | 1573.89 | 787.95 | 788.17 |
| 625 | 1358 | Ac-FTF$r8VYWSQL$S-NH2 | 1609.85 | 805.93 | 806.22 |
| 626 | 1359 | Ac-ITF$r8FYWAQL$S-NH2 | 1607.88 | 804.94 | 805.2 |
| 627 | 1360 | Ac-2NalTF$r8VYWSQL$S-NH2 | 1659.87 | 830.94 | 831.2 |
| 628 | 1361 | Ac-ITF$r8LYWSQL$S-NH2 | 1589.89 | 795.95 | 796.13 |
| 629 | 1362 | Ac-FTF$r8FYWAQL$S-NH2 | 1641.86 | 821.93 | 822.13 |
| 630 | 1363 | Ac-WTF$r8VYWAQL$S-NH2 | 1632.87 | 817.44 | 817.69 |
| 631 | 1364 | Ac-WTF$r8WYWAQL$S-NH2 | 1719.88 | 860.94 | 861.36 |
| 632 | 1365 | Ac-VTF$r8AYWSQL$S-NH2 | 1533.82 | 767.91 | 768.19 |
| 633 | 1366 | Ac-WTF$r8FYWSQL$S-NH2 | 1696.87 | 849.44 | 849.7 |
| 634 | 1367 | Ac-FTF$r8IYWAQL$S-NH2 | 1607.88 | 804.94 | 805.2 |
| 635 | 1368 | Ac-WTF$r8VYWSQL$S-NH2 | 1648.87 | 825.44 | 824.8 |
| 636 | 1369 | Ac-FTF$r8LYWSQL$S-NH2 | 1623.87 | 812.94 | 812.8 |
| 637 | 1370 | Ac-YTF$r8FYWSQL$S-NH2 | 1673.85 | 837.93 | 837.8 |
| 638 | 1371 | Ac-LTF$r8AY6clWEAL$A-NH2 | 1550.79 | 776.40 | 776.14 |
| 639 | 1372 | Ac-LTF$r8AY6clWSQL$S-NH2 | 1581.80 | 791.90 | 791.68 |
| 640 | 1373 | Ac-F$r8AY6clWSAL$A-NH2 | 1294.65 | 648.33 | 647.67 |
| 641 | 1374 | Ac-F$r8AY6clWQAL$AA-NH2 | 1406.72 | 704.36 | 703.84 |
| 642 | 1375 | Ac-LHF$r8AYWAQL$S-NH2 | 1567.86 | 784.93 | 785.21 |
| 643 | 1376 | Ac-LTF$r8AYWAQL$S-NH2 | 1531.84 | 766.92 | 767.17 |
| 644 | 1377 | Ac-LTF$r8AHWAQL$S-NH2 | 1505.84 | 753.92 | 754.13 |
| 645 | 1378 | Ac-LTF$r8AYWAHL$S-NH2 | 1540.84 | 771.42 | 771.61 |
| 646 | 1379 | Ac-LTF$r8AYWAQL$H-NH2 | 1581.87 | 791.94 | 792.15 |
| 647 | 1380 | H-LTF$r8AYWAQL$A-NH2 | 1473.84 | 737.92 | 737.29 |
| 648 | 1381 | Ac-HHF$r8AYWAQL$S-NH2 | 1591.83 | 796.92 | 797.35 |
| 649 | 1382 | Ac-aAibWTF$r8VYWSQL$S-NH2 | 1804.96 | 903.48 | 903.64 |
| 650 | 1383 | Ac-AibWTF$r8HYWAQL$S-NH2 | 1755.91 | 878.96 | 879.4 |
| 651 | 1384 | Ac-AibAWTF$r8HYWAQL$S-NH2 | 1826.95 | 914.48 | 914.7 |
| 652 | 1385 | Ac-fWTF$r8HYWAQL$S-NH2 | 1817.93 | 909.97 | 910.1 |
| 653 | 1386 | Ac-AibWWTF$r8HYWAQL$S-NH2 | 1941.99 | 972.00 | 972.2 |
| 654 | 1387 | Ac-WTF$r8LYWSQL$S-NH2 | 1662.88 | 832.44 | 832.8 |
| 655 | 1388 | Ac-WTF$r8NleYWSQL$S-NH2 | 1662.88 | 832.44 | 832.6 |
| 656 | 1389 | Ac-LTF$r8AYWSQL$a-NH2 | 1531.84 | 766.92 | 767.2 |
| 657 | 1390 | Ac-LTF$r8EYWARL$A-NH2 | 1601.90 | 801.95 | 802.1 |
| 658 | 1391 | Ac-LTF$r8EYWAHL$A-NH2 | 1582.86 | 792.43 | 792.6 |

TABLE 2b-continued

| Number | SEQ ID NO: | Sequence | Exact Mass | M + 2 | Observed mass (m/e) |
|---|---|---|---|---|---|
| 659 | 1392 | Ac-aTF$r8AYWAQL$S-NH2 | 1489.80 | 745.90 | 746.08 |
| 660 | 1393 | Ac-AibTF$r8AYWAQL$S-NH2 | 1503.81 | 752.91 | 753.11 |
| 661 | 1394 | Ac-AmfTF$r8AYWAQL$S-NH2 | 1579.84 | 790.92 | 791.14 |
| 662 | 1395 | Ac-AmwTF$r8AYWAQL$S-NH2 | 1618.86 | 810.43 | 810.66 |
| 663 | 1396 | Ac-NmLTF$r8AYWAQL$S-NH2 | 1545.86 | 773.93 | 774.11 |
| 664 | 1397 | Ac-LNmTF$r8AYWAQL$S-NH2 | 1545.86 | 773.93 | 774.11 |
| 665 | 1398 | Ac-LSarF$r8AYWAQL$S-NH2 | 1501.83 | 751.92 | 752.18 |
| 667 | 1399 | Ac-LGF$r8AYWAQL$S-NH2 | 1487.82 | 744.91 | 745.15 |
| 668 | 1400 | Ac-LTNmF$r8AYWAQL$S-NH2 | 1545.86 | 773.93 | 774.2 |
| 669 | 1401 | Ac-TF$r8AYWAQL$S-NH2 | 1418.76 | 710.38 | 710.64 |
| 670 | 1402 | Ac-ETF$r8AYWAQL$A-NH2 | 1531.81 | 766.91 | 767.2 |
| 671 | 1403 | Ac-LTF$r8EYWAQL$A-NH2 | 1573.85 | 787.93 | 788.1 |
| 672 | 1404 | Ac-LT2Nal$r8AYWSQL$S-NH2 | 1597.85 | 799.93 | 800.4 |
| 673 | 1405 | Ac-LTF$r8AYWAAL$S-NH2 | 1474.82 | 738.41 | 738.68 |
| 674 | 1406 | Ac-LTF$r8AYWAQhCha$S-NH2 | 1585.89 | 793.95 | 794.19 |
| 675 | 1407 | Ac-LTF$r8AYWAQChg$S-NH2 | 1557.86 | 779.93 | 780.97 |
| 676 | 1408 | Ac-LTF$r8AYWAQCba$S-NH2 | 1543.84 | 772.92 | 773.19 |
| 677 | 1409 | Ac-LTF$r8AYWAQF3CF3$S-NH2 | 1633.82 | 817.91 | 818.15 |
| 678 | 1410 | Ac-LTF$r8AYWAQlNal$S-NH2 | 1615.84 | 808.92 | 809.18 |
| 679 | 1411 | Ac-LTF$r8AYWAQBip$S-NH2 | 1641.86 | 821.93 | 822.32 |
| 680 | 1412 | Ac-LT2Nal$r8AYWAQL$S-NH2 | 1581.86 | 791.93 | 792.15 |
| 681 | 1413 | Ac-LTF$r8AYWVQL$S-NH2 | 1559.88 | 780.94 | 781.62 |
| 682 | 1414 | Ac-LTF$r8AWWAQL$S-NH2 | 1554.86 | 778.43 | 778.65 |
| 683 | 1415 | Ac-FTF$r8VYWSQL$S-NH2 | 1609.85 | 805.93 | 806.12 |
| 684 | 1416 | Ac-ITF$r8FYWAQL$S-NH2 | 1607.88 | 804.94 | 805.2 |
| 685 | 1417 | Ac-ITF$r8LYWSQL$S-NH2 | 1589.89 | 795.95 | 796.22 |
| 686 | 1418 | Ac-FTF$r8FYWAQL$S-NH2 | 1641.86 | 821.93 | 822.41 |
| 687 | 1419 | Ac-VTF$r8AYWSQL$S-NH2 | 1533.82 | 767.91 | 768.19 |
| 688 | 1420 | Ac-LTF$r8AHWAQL$S-NH2 | 1505.84 | 753.92 | 754.31 |
| 689 | 1421 | Ac-LTF$r8AYWAQL$H-NH2 | 1581.87 | 791.94 | 791.94 |
| 690 | 1422 | Ac-LTF$r8AYWAHL$S-NH2 | 1540.84 | 771.42 | 771.61 |
| 691 | 1423 | Ac-aAibWTF$r8VYWSQL$S-NH2 | 1804.96 | 903.48 | 903.9 |
| 692 | 1424 | Ac-AibWTF$r8HYWAQL$S-NH2 | 1755.91 | 878.96 | 879.5 |
| 693 | 1425 | Ac-AibAWTF$r8HYWAQL$S-NH2 | 1826.95 | 914.48 | 914.7 |
| 694 | 1426 | Ac-fWTF$r8HYWAQL$S-NH2 | 1817.93 | 909.97 | 910.2 |
| 695 | 1427 | Ac-AibWWTFSr8HYWAQL$S-NH2 | 1941.99 | 972.00 | 972.7 |
| 696 | 1428 | Ac-WTF$r8LYWSQL$S-NH2 | 1662.88 | 832.44 | 832.7 |
| 697 | 1429 | Ac-WTF$r8NleYWSQL$S-NH2 | 1662.88 | 832.44 | 832.7 |

TABLE 2b-continued

| Number | SEQ ID NO: | Sequence | Exact Mass | M + 2 | Observed mass (m/e) |
|---|---|---|---|---|---|
| 698 | 1430 | Ac-LTF$r8AYWSQL$a-NH2 | 1531.84 | 766.92 | 767.2 |
| 699 | 1431 | Ac-LTF$r8EYWARL$A-NH2 | 1601.90 | 801.95 | 802.2 |
| 700 | 1432 | Ac-LTF$r8EYWAHL$A-NH2 | 1582.86 | 792.43 | 792.6 |
| 701 | 1433 | Ac-aTF$r8AYWAQL$S-NH2 | 1489.80 | 745.90 | 746.1 |
| 702 | 1434 | Ac-AibTF$r8AYWAQL$S-NH2 | 1503.81 | 752.91 | 753.2 |
| 703 | 1435 | Ac-AmfTF$r8AYWAQL$S-NH2 | 1579.84 | 790.92 | 791.2 |
| 704 | 1436 | Ac-AmwTF$r8AYWAQL$S-NH2 | 1618.86 | 810.43 | 810.7 |
| 705 | 1437 | Ac-NmLTF$r8AYWAQL$S-NH2 | 1545.86 | 773.93 | 774.1 |
| 706 | 1438 | Ac-LNmTF$r8AYWAQL$S-NH2 | 1545.86 | 773.93 | 774.4 |
| 707 | 1439 | Ac-LSarF$r8AYWAQL$S-NH2 | 1501.83 | 751.92 | 752.1 |
| 708 | 1440 | Ac-TF$r8AYWAQL$S-NH2 | 1418.76 | 710.38 | 710.8 |
| 709 | 1441 | Ac-ETF$r8AYWAQL$A-NH2 | 1531.81 | 766.91 | 767.4 |
| 710 | 1442 | Ac-LTF$r8EYWAQL$A-NH2 | 1573.85 | 787.93 | 788.2 |
| 711 | 1443 | Ac-WTF$r8VYWSQL$S-NH2 | 1648.87 | 825.44 | 825.2 |
| 713 | 1444 | Ac-YTF$r8FYWSQL$S-NH2 | 1673.85 | 837.93 | 837.3 |
| 714 | 1445 | Ac-F$r8AY6clWSAL$A-NH2 | 1294.65 | 648.33 | 647.74 |
| 715 | 1446 | Ac-ETF$r8EYWVQL$S-NH2 | 1633.84 | 817.92 | 817.36 |
| 716 | 1447 | Ac-ETF$r8EHWAQL$A-NH2 | 1563.81 | 782.91 | 782.36 |
| 717 | 1448 | Ac-ITF$r8EYWAQL$S-NH2 | 1589.85 | 795.93 | 795.38 |
| 718 | 1449 | Ac-ITF$r8EHWVQL$A-NH2 | 1575.88 | 788.94 | 788.42 |
| 719 | 1450 | Ac-ITF$r8EHWAQL$S-NH2 | 1563.85 | 782.93 | 782.43 |
| 720 | 1451 | Ac-LTF4F$r8AYWAQCba$S-NH2 | 1561.83 | 781.92 | 781.32 |
| 721 | 1452 | Ac-LTF3Cl$r8AYWAQhL$S-NH2 | 1579.82 | 790.91 | 790.64 |
| 722 | 1453 | Ac-LTF3Cl$r8AYWAQCha$S-NH2 | 1605.84 | 803.92 | 803.37 |
| 723 | 1454 | Ac-LTF3Cl$r8AYWAQChg$S-NH2 | 1591.82 | 796.91 | 796.27 |
| 724 | 1455 | Ac-LTF3Cl$r8AYWAQCba$S-NH2 | 1577.81 | 789.91 | 789.83 |
| 725 | 1456 | Ac-LTF$r8AY6clWSQL$S-NH2 | 1581.80 | 791.90 | 791.75 |
| 726 | 1457 | Ac-LTF4F$r8HYWAQhL$S-NH2 | 1629.87 | 815.94 | 815.36 |
| 727 | 1458 | Ac-LTF4F$r8HYWAQCba$S-NH2 | 1627.86 | 814.93 | 814.32 |
| 728 | 1459 | Ac-LTF4F$r8AYWAQhL$S-NH2 | 1563.85 | 782.93 | 782.36 |
| 729 | 1460 | Ac-LTF4F$r8AYWAQChg$S-NH2 | 1575.85 | 788.93 | 788.35 |
| 730 | 1461 | Ac-ETF$r8EYWVAL$S-NH2 | 1576.82 | 789.41 | 788.79 |
| 731 | 1462 | Ac-ETF$r8EHWAAL$A-NH2 | 1506.79 | 754.40 | 754.8 |
| 732 | 1463 | Ac-ITF$r8EYWAAL$S-NH2 | 1532.83 | 767.42 | 767.75 |
| 733 | 1464 | Ac-ITF$r8EHWVAL$A-NH2 | 1518.86 | 760.43 | 760.81 |
| 734 | 1465 | Ac-ITF$r8EHWAAL$S-NH2 | 1506.82 | 754.41 | 754.8 |
| 735 | 1466 | Pam-LTF$r8EYWAQL$S-NH2 | 1786.07 | 894.04 | 894.48 |
| 736 | 1467 | Pam-ETF$r8EYWAQL$S-NH2 | 1802.03 | 902.02 | 902.34 |

TABLE 2b-continued

| Number | SEQ ID NO: | Sequence | Exact Mass | M + 2 | Observed mass (m/e) |
|---|---|---|---|---|---|
| 737 | 1468 | Ac-LTF$r8AYWLQL$S-NH2 | 1573.89 | 787.95 | 787.39 |
| 738 | 1469 | Ac-LTF$r8EYWLQL$S-NH2 | 1631.90 | 816.95 | 817.33 |
| 739 | 1470 | Ac-LTF$r8EHWLQL$S-NH2 | 1605.89 | 803.95 | 804.29 |
| 740 | 1471 | Ac-LTF$r8VYWAQL$S-NH2 | 1559.88 | 780.94 | 781.34 |
| 741 | 1472 | Ac-LTF$r8AYWSQL$S-NH2 | 1547.84 | 774.92 | 775.33 |
| 742 | 1473 | Ac-ETF$r8AYWAQL$S-NH2 | 1547.80 | 774.90 | 775.7 |
| 743 | 1474 | Ac-LTF$r8EYWAQL$S-NH2 | 1589.85 | 795.93 | 796.33 |
| 744 | 1475 | Ac-LTF$r8HYWAQL$S-NHAm | 1667.94 | 834.97 | 835.37 |
| 745 | 1476 | Ac-LTF$r8HYWAQL$S-NHiAm | 1667.94 | 834.97 | 835.27 |
| 746 | 1477 | Ac-LTF$r8HYWAQL$S-NHnPr3Ph | 1715.94 | 858.97 | 859.42 |
| 747 | 1478 | Ac-LTF$r8HYWAQL$S-NHnBu3,3Me | 1681.96 | 841.98 | 842.67 |
| 748 | 1479 | Ac-LTF$r8HYWAQL$S-NHnBu | 1653.93 | 827.97 | 828.24 |
| 749 | 1480 | Ac-LTF$r8HYWAQL$S-NHnPr | 1639.91 | 820.96 | 821.31 |
| 750 | 1481 | Ac-LTF$r8HYWAQL$S-NHnEt2Ch | 1707.98 | 854.99 | 855.35 |
| 751 | 1482 | Ac-LTF$r8HYWAQL$S-NHHex | 1681.96 | 841.98 | 842.4 |
| 752 | 1483 | Ac-LTF$r8AYWAQL$S-NHmdPeg2 | 1633.91 | 817.96 | 855.35 |
| 753 | 1484 | Ac-LTF$r8AYWAQL$A-NHmdPeg2 | 1617.92 | 809.96 | 810.58 |
| 754 | 1485 | Ac-LTF$r5AYWAAL$s8S-NH2 | 1474.82 | 738.41 | 738.79 |
| 755 | 1486 | Ac-LTF$r8AYWCouQL$S-NH2 | 1705.88 | 853.94 | 854.61 |
| 756 | 1487 | Ac-LTF$r8CouYWAQL$S-NH2 | 1705.88 | 853.94 | 854.7 |
| 757 | 1488 | Ac-CouTFSr8AYWAQL$S-NH2 | 1663.83 | 832.92 | 833.33 |
| 758 | 1489 | H-LTF$r8AYWAQL$A-NH2 | 1473.84 | 737.92 | 737.29 |
| 759 | 1490 | Ac-HHF$r8AYWAQL$S-NH2 | 1591.83 | 796.92 | 797.72 |
| 760 | 1491 | Ac-LT2Nal$r8AYWSQL$S-NH2 | 1597.85 | 799.93 | 800.68 |
| 761 | 1492 | Ac-LTF$r8HCouWAQL$S-NH2 | 1679.87 | 840.94 | 841.38 |
| 762 | 1493 | Ac-LTF$r8AYWCou2QL$S-NH2 | 1789.94 | 895.97 | 896.51 |
| 763 | 1494 | Ac-LTF$r8Cou2YWAQL$S-NH2 | 1789.94 | 895.97 | 896.5 |
| 764 | 1495 | Ac-Cou2TF$r8AYWAQL$S-NH2 | 1747.90 | 874.95 | 875.42 |
| 765 | 1496 | Ac-LTF$r8ACou2WAQL$S-NH2 | 1697.92 | 849.96 | 850.82 |
| 766 | 1497 | Dmaac-LTF$r8AYWAQL$S-NH2 | 1574.89 | 788.45 | 788.82 |
| 767 | 1498 | Hexac-LTF$r8AYWAQL$S-NH2 | 1587.91 | 794.96 | 795.11 |
| 768 | 1499 | Napac-LTF$r8AYWAQL$S-NH2 | 1657.89 | 829.95 | 830.36 |
| 769 | 1500 | Pam-LTF$r8AYWAQL$S-NH2 | 1728.06 | 865.03 | 865.45 |
| 770 | 1501 | Ac-LT2Nal$r8HYAAQL$S-NH2 | 1532.84 | 767.42 | 767.61 |
| 771 | 1502 | Ac-LT2Nal$/r8HYWAQL$/S-NH2 | 1675.91 | 838.96 | 839.1 |
| 772 | 1503 | Ac-LT2Nal$r8HYFAQL$S-NH2 | 1608.87 | 805.44 | 805.9 |
| 773 | 1504 | Ac-LT2Nal$r8HWAAQL$S-NH2 | 1555.86 | 778.93 | 779.08 |
| 774 | 1505 | Ac-LT2Nal$r8HYAWQL$S-NH2 | 1647.88 | 824.94 | 825.04 |

TABLE 2b-continued

| Number | SEQ ID NO: | Sequence | Exact Mass | M + 2 | Observed mass (m/e) |
|---|---|---|---|---|---|
| 775 | 1506 | Ac-LT2Nal$r8HYAAQW$S-NH2 | 1605.83 | 803.92 | 804.05 |
| 776 | 1507 | Ac-LTW$r8HYWAQL$S-NH2 | 1636.88 | 819.44 | 819.95 |
| 777 | 1508 | Ac-LT1Nal$r8HYWAQL$S-NH2 | 1647.88 | 824.94 | 825.41 |

In some embodiments, the peptidomimetic macrocycles disclosed herein do not comprise a peptidomimetic macrocycle structure as shown in Table 2b.

Table 2c shows examples of non-crosslinked polypeptides comprising D-amino acids.

TABLE 2c

| SP | SEQ ID NO: | Sequence | Isomer | Exact Mass | Found Mass | Calc (M + 1)/1 | Calc (M + 2)/2 | Calc (M + 3)/3 |
|---|---|---|---|---|---|---|---|---|
| SP778 | 1509 | Ac-tawyanfekllr-NH2 | | | 777.46 | | | |
| SP779 | 1510 | Ac-tawyanf4CF3ekllr-NH2 | | | 811.41 | | | |

Influenza B viruses are usually found in humans but can also infect seals. Unlike influenza A viruses, these viruses are not classified according to subtype. Influenza B viruses can cause morbidity and mortality among humans, but in general are associated with less severe epidemics than influenza A viruses. Although influenza type B viruses can cause human epidemics, they have not caused pandemics.

Influenza type C viruses cause mild illness in humans and do not cause epidemics or pandemics. These viruses can also infect dogs and pigs. These viruses are not classified according to subtype.

Influenza viruses differ from each other in respect to cell surface receptor specificity and cell tropism, however they use common entry pathways. Charting these pathways and identification of host cell proteins involved in virus influenza transmission, entry, replication, biosynthesis, assembly, or exit allows the development of general agents against existing and emerging strains of influenza. The agents can also prove useful against unrelated viruses that use similar pathways. For example, the agents can protect airway epithelial cells against a number of different viruses in addition to influenza viruses.

In one embodiment the targeted virus is an adenovirus. Adenoviruses most commonly cause respiratory illness; symptoms of respiratory illness caused by adenovirus infection range from the common cold syndrome to pneumonia, croup, and bronchitis. Patients with compromised immune systems are especially susceptible to severe complications of adenovirus infection. Acute respiratory disease (ARD), first recognized among military recruits during World War II, can be caused by adenovirus infections during conditions of crowding and stress. Adenoviruses are medium-sized (90-100 nm), nonenveloped icosohedral viruses containing double-stranded DNA. There are 49 immunologically distinct types (6 subgenera: A through F) that can cause human infections. Adenoviruses are unusually stable to chemical or physical agents and adverse pH conditions, allowing for prolonged survival outside of the body. Some adenoviruses, such as AD2 and Ad5 (species C) use clathrin mediated endocytosis and macropinocytosis for infectious entry. Other adenoviruses, such as Ad3 (species B) use dynamin dependent endocytosis and macropinocytosis for infectious entry.

Peptidomimetic macrocycles can also be prepared that target or interact with proteins that a virus needs for infection or replication within a host cell. Such viruses can be, for example, influenza viruses belonging to Orthomyxoviridae family of viruses. This family also includes Thogoto viruses and Dhoriviruses. There are several types and subtypes of influenza viruses known, which infect humans and other species. Influenza type A viruses infect people, birds, pigs, horses, seals and other animals, but wild birds are the natural hosts for these viruses. Influenza type A viruses are divided into subtypes and named on the basis of two proteins on the surface of the virus: hemagglutinin (HA) and neuraminidase (NA). For example, an "H7N2 virus" designates an influenza A subtype that has an HA7 protein and an NA2 protein. Similarly an "H5N1" virus has an HA 5 protein and an NA1 protein. There are 16 known HA subtypes and 9 known NA subtypes. Many different combinations of HA and NA proteins are possible. Only some influenza A subtypes (i.e., H1N1, H1N2, and H3N2) are currently in general circulation among people. Other subtypes are found most commonly in other animal species. For example, H7N7 and H3N8 viruses cause illness in horses, and H3N8 also has recently been shown to cause illness in dogs.

Antiviral agents according to the invention can be used to protect high-risk groups (hospital units, institutes caring for elderly, immuno-suppressed individuals), and on a case by case basis. A potential use for antiviral agents is to limit the spread and severity of the future pandemics whether caused by avian H5N1 or other strains of influenza virus. Avian influenza A viruses of the subtypes H5 and H7, including H5N1, H7N7, and H7N3 viruses, have been associated with high pathogenicity, and human infection with these viruses have ranged from mild (H7N3, H7N7) to severe and fatal disease (H7N7, H5N1). Human illness due to infection with low pathogenicity viruses has been documented, including very mild symptoms (e.g., conjunctivitis) to influenza-like illness. Examples of low pathogenicity viruses that have infected humans include H7N7, H9N2, and H7N2.

In one embodiment the targeted virus is a respiratory syncytial virus (RSV). RSV is the most common cause of bronchiolitis and pneumonia among infants and children under 1 year of age. Illness begins most frequently with fever, runny nose, cough, and sometimes wheezing. During their first RSV infection, between 25% and 40% of infants and young children have signs or symptoms of bronchiolitis or pneumonia, and 0.5% to 2% require hospitalization. Most children recover from illness in 8 to 15 days. The majority of children hospitalized for RSV infection are under 6 months of age. RSV also causes repeated infections throughout life, usually associated with moderate-to-severe cold-like symptoms; however, severe lower respiratory tract disease can occur at any age, especially among the elderly or among those with compromised cardiac, pulmonary, or immune systems. RSV is a negative-sense, enveloped RNA virus. The virion is variable in shape and size (average diameter of between 120 and 300 nm), is unstable in the environment (surviving only a few hours on environmental surfaces), and is readily inactivated with soap and water and disinfectants.

In one embodiment the targeted virus is a human parainfluenza virus (HPIV). HPIVs are second to respiratory syncytial virus (RSV) as a common cause of lower respiratory tract disease in young children. Similar to RSV, HPIVs can cause repeated infections throughout life, usually manifested by an upper respiratory tract illness (e.g., a cold and/or sore throat). HPIVs can also cause serious lower respiratory tract disease with repeat infection (e.g., pneumonia, bronchitis, and bronchiolitis), especially among the elderly, and among patients with compromised immune systems. Each of the four HPIVs has different clinical and epidemiologic features. The most distinctive clinical feature of HPIV-1 and HPIV-2 is croup (i.e., laryngotracheobronchitis); HPIV-1 is the leading cause of croup in children, whereas HPIV-2 is less frequently detected. Both HPIV-1 and -2 can cause other upper and lower respiratory tract illnesses. HPIV-3 is more often associated with bronchiolitis and pneumonia. HPIV-4 is infrequently detected, possibly because it is less likely to cause severe disease. The incubation period for HPIVs is generally from 1 to 7 days. HPIVs are negative-sense, single-stranded RNA viruses that possess fusion and hemagglutinin-neuraminidase glycoprotein "spikes" on their surface. There are four serotypes types of HPIV (1 through 4) and two subtypes (4a and 4b). The virion varies in size (average diameter between 150 and 300 nm) and shape, is unstable in the environment (surviving a few hours on environmental surfaces), and is readily inactivated with soap and water.

In one embodiment the targeted virus is a coronavirus. Coronavirus is a genus of animal virus belonging to the family Coronaviridae. Coronaviruses are enveloped viruses with a positive-sense single-stranded RNA genome and a helical symmetry. The genomic size of coronaviruses ranges from approximately 16 to 31 kilobases, extraordinarily large for an RNA virus. The name "coronavirus" is derived from the Latin corona, meaning crown, as the virus envelope appears under electron microscopy to be crowned by a characteristic ring of small bulbous structures. This morphology is actually formed by the viral spike peplomers, which are proteins that populate the surface of the virus and determine host tropism. Coronaviruses are grouped in the order Nidovirales, named for the Latin nidus, meaning nest, as all viruses in this order produce a 3' co-terminal nested set of subgenomic mRNAs during infection. Proteins that contribute to the overall structure of all coronaviruses are the spike, envelope, membrane and nucleocapsid. In the specific case of SARS a defined receptor-binding domain on S mediates the attachment of the virus to its cellular receptor, angiotensin-converting enzyme 2.

In one embodiment the targeted virus is a rhinovirus. Rhinovirus is a genus of the Picornaviridae family of viruses. Rhinoviruses are the most common viral infective agents in humans, and a causative agent of the common cold. There are over 105 serologic virus types that cause cold symptoms, and rhinoviruses are responsible for approximately 50% of all cases. Rhinoviruses have single-stranded positive sense RNA genomes of between 7.2 and 8.5 kb in length. At the 5' end of the genome is a virus-encoded protein, and like mammalian mRNA, there is a 3' poly-A tail. Structural proteins are encoded in the 5' region of the genome and nonstructural at the end. This is the same for all picornaviruses. The viral particles themselves are not enveloped and are icosahedral in structure.

Any secondary structure of a viral protein (or of a host cell protein involved in viral infectivity) can form the basis of the methods. For example, a viral protein comprising a secondary structure which is a helix can be used to design peptidomimetic macrocycles based on the helix.

In one embodiment, the peptidomimetic macrocycle is designed based on the PB1 or PB2 sequence of an influenza virus. The PB1 sequence is highly conserved across all known strains of influenza A virus, which can result in less drug resistance should than that observed with the current standard of care. An alignment of the first 25 N-terminal amino acids of PB1 from the NCBI data bank's 2,485 influenza A virus strains (Ghanem, 2007) demonstrates the remarkable sequence conservation in the PA interaction domain of PB1. Therefore, antiviral therapies based on the PB1 sequence can block most, if not all, influenza A virus strains. Additionally, sequence modification of a peptidomimetic macrocycle based on these few variations in PB1 can enable an antiviral cocktail of PB1 inhibitors to eliminate resistance due to escape mutants.

Table 3a shows a list of peptidomimetic macrocycles derived from the PA-binding helix of PB1 that were prepared.

Table 3b shows a list of selected peptidomimetic macrocycles from Table 3a. SP-791 and SP-794 were prepared by increasing the length and alanine content (%) of the SP-786 sequence. These modifications led to a five-fold increase in antiviral activity compared to that of SP-786. SP-798 was prepared by incorporating an i, i+7 crosslink instead of the i, i+4 crosslink of SP-786. SP-192 exhibited improved anti-viral activity ($EC_{50}$=4.5 mM) compared to that of SP-786.

In some embodiments, the invention provides a peptidomimetic macrocycle that comprises an amino acid sequence that has at least 60%, 70%, 80%, 90%, 95%, 97%, or 100% identity to any one of the amino acid sequences in Table 3a or 3b.

TABLE 3a

Prepared peptidomimetic macrocycles derived from the PA-binding helix of pB1.

| SP# | SEQ ID NO: | | | 1 | 2 | 3 | 4 | 5 | 6 | 7 | 8 | 9 | 10 | 11 | 12 | 13 | 14 | 15 | 16 | 17 | |
|---|---|---|---|---|---|---|---|---|---|---|---|---|---|---|---|---|---|---|---|---|---|
| 780 | 1511 | Ac— | | Nle | D | V | N | $ | T | L | L | $ | L | K | V | Aib | A | Q | | | —$NH_2$ |
| 781 | 1512 | Ac— | | Nle | D | V | N | $ | T | L | L | $ | L | K | A | Aib | A | Q | | | —$NH_2$ |
| 782 | 1513 | Ac— | | Nle | D | V | N | $ | T | L | L | $ | L | K | V | Aib | A | A | | | —$NH_2$ |
| 783 | 1514 | Ac— | | Nle | D | V | N | $ | T | L | L | $ | L | K | V | P | Aib | Q | | | —$NH_2$ |
| 784 | 1515 | Ac— | | F | D | V | N | $ | T | L | L | $ | L | K | V | Aib | A | Q | | | —$NH_2$ |
| 785 | 1516 | 5-FAM— | Ba | Nle | D | V | N | $ | T | L | L | $ | L | A | V | Aib | A | Q | | | —$NH_2$ |
| 786 | 1517 | Ac— | | Nle | D | V | N | $ | T | L | L | $ | L | A | V | Aib | A | Q | | | —$NH_2$ |
| 787 | 1518 | Ac— | | Nle | D | V | N | $ | T | L | L | $ | L | A | V | Aib | A | Q | A | A | —$NH_2$ |
| 788 | 1519 | Ac— | | Nle | D | V | N | $ | T | L | L | $ | L | A | V | A | A | Q | A | A | —$NH_2$ |
| 789 | 1520 | Ac— | | Nle | D | V | N | $ | T | L | L | $ | L | A | V | A | A | A | A | A | —$NH_2$ |
| 790 | 1521 | Ac— | | Nle | D | V | N | $ | T | L | L | $ | L | A | V | S | A | Q | A | A | —$NH_2$ |
| 791 | 1522 | Ac— | | Nle | D | V | N | $ | T | L | L | $ | L | A | V | Q | A | Q | A | A | —$NH_2$ |
| 792 | 1523 | Ac— | | Nle | D | V | N | $ | T | L | L | $ | L | A | V | E | A | Q | A | A | —$NH_2$ |
| 793 | 1524 | Ac— | | Nle | D | V | N | $ | T | L | L | $ | L | A | V | S | A | A | A | A | —$NH_2$ |
| 794 | 1525 | Ac— | | Nle | D | V | N | $ | T | L | L | $ | L | A | V | Q | A | A | A | A | —$NH_2$ |
| 795 | 1526 | Ac— | | Nle | D | V | N | $ | T | L | L | $ | L | A | V | E | A | A | A | A | —$NH_2$ |
| 796 | 1527 | Ac— | | Nle | D | V | N | $ | T | L | L | $ | L | A | V | Aib | A | Q | A | a | —$NH_2$ |
| 797 | 1528 | Ac— | | Nle | D | V | N | $ | T | L | L | $ | L | A | V | Aib | A | Q | A | a | —OH |
| 798 | 1529 | Ac— | | Nle | D | V | N | $r8 | T | L | L | F | L | A | $ | A | A | Q | | | —$NH_2$ |
| 799 | 1530 | Ac— | | Nle | D | V | N | $ | T | L | L | $ | L | A | V | Q | Aib | Q | A | A | —$NH_2$ |
| 800 | 1531 | Ac— | | Nle | D | V | N | $ | T | L | L | $ | L | A | V | Q | A | Q | Aib | A | —$NH_2$ |
| 801 | 1532 | Ac— | | Nle | D | V | N | $ | T | L | L | $ | L | A | V | Q | Aib | A | A | A | —$NH_2$ |
| 802 | 1533 | Ac— | | Nle | D | V | N | $ | T | L | L | $ | L | A | V | Q | A | A | Aib | A | —$NH_2$ |
| 803 | 1534 | Ac— | | Nle | D | V | N | $ | T | L | L | $ | L | A | V | Q | A | Aib | A | A | —$NH_2$ |
| 804 | 1535 | Ac— | | Nle | D | V | N | $r8 | T | L | L | F | L | A | $ | A | A | Q | A | A | —$NH_2$ |
| 805 | 1536 | Ac— | | Nle | D | V | N | $r8 | T | L | L | F | L | A | $ | A | A | A | A | A | —$NH_2$ |
| 806 | 1537 | Ac— | | Nle | D | V | N | $r8 | T | L | L | F | L | A | $ | Q | A | Q | A | A | —$NH_2$ |
| 807 | 1538 | Ac— | | Nle | D | V | N | $r8 | T | L | L | F | L | A | $ | Q | A | A | A | A | —$NH_2$ |

TABLE 3b

Selected peptidomimetic macrocycles derived from the PA-binding helix of pB1.

| SP# | Crosslink | Ch | L | VH | RT (min)* | Ala (%) | CPE, $EC_{50}$ (μM)** |
|---|---|---|---|---|---|---|---|
| 786 | i, i + 4 | −1 | 15 | 4.7 | 10.68 | 13 | 23 |
| 791 | i, i + 4 | −1 | 17 | 7.2 | 8.02 | 24 | 4.1 |
| 794 | i, i + 4 | −1 | 17 | 5.1 | 9.54 | 29 | 6.1 |
| 799 | i, i + 4 | −1 | 17 | 7 | | 18 | <6.1*** |
| 800 | i, i + 4 | −1 | 17 | 7 | 8.47 | 18 | <6.1*** |
| 801 | i, i + 4 | −1 | 17 | 4.9 | 10.01 | 24 | <6.1*** |
| 802 | i, i + 4 | −1 | 17 | 4.9 | 10.18 | 24 | <6.1*** |
| 803 | i, i + 4 | −1 | 17 | 4.9 | 10.26 | 24 | <6.1*** |
| 798 | i, i + 7 | −1 | 15 | 4.9 | 10.18 | 20 | 4.5 |
| 804 | i, i + 7 | −1 | 17 | 5.1 | 10.92 | 29 | <4.5*** |
| 805 | i, i + 7 | −1 | 17 | 3 | 13.03 | 35 | <4.5*** |
| 806 | i, i + 7 | −1 | 17 | 7.2 | 8.86 | 24 | <4.5*** |
| 807 | i, i + 7 | −1 | 17 | 5.1 | 10.83 | 29 | <4.5*** |

*See Example 11 table

**By Neutral Red assay (Influenza A Virus H1N1 California/07/2009)

***Predicted

Ch = net charge;

L = length in amino acids;

VH = von Heijne;

RT = retention time;

Ala = alanine content

In some embodiments of the invention, the peptide sequence is derived from the BCL-2 family of proteins. The BCL-2 family is defined by the presence of up to four conserved BCL-2 homology (BH) domains designated BH1, BH2, BH3, and BH4, all of which include α-helical segments (Chittenden et al. (1995), *EMBO* 14:5589; Wang et al. (1996), *Genes Dev.* 10:2859). Anti-apoptotic proteins, such as BCL-2 and BCL-XL, display sequence conservation in all BH domains. Pro-apoptotic proteins are divided into "multidomain" family members (e.g., BAK, BAX), which possess homology in the BH1, BH2, and BH3 domains, and "BH3-domain only" family members (e.g., BID, BAD, BIM, BIK, NOXA, PUMA), that contain sequence homology exclusively in the BH3 amphipathic α-helical segment. BCL-2 family members have the capacity to form homo- and heterodimers, suggesting that competitive binding and the ratio between pro- and anti-apoptotic protein levels dictates susceptibility to death stimuli. Anti-apoptotic proteins function to protect cells from pro-apoptotic excess, i.e., excessive programmed cell death. Additional "security" measures include regulating transcription of pro-apoptotic proteins and maintaining them as inactive conformers, requiring either proteolytic activation, dephosphorylation, or ligand-induced conformational change to activate pro-death functions. In certain cell types, death signals received at the plasma membrane trigger apoptosis via a mitochondrial pathway. The mitochondria can serve as a gatekeeper of cell death by sequestering cytochrome c, a critical component of a cytosolic complex which activates caspase 9, leading to fatal downstream proteolytic events. Multidomain proteins such as BCL-2/BCL-$X_L$ and BAK/BAX play dueling roles of guardian and executioner at the mitochondrial membrane, with their activities further regulated by upstream BH3-only members of the BCL-2 family. For example, BID is a member of the BH3-domain only family of pro-apoptotic proteins, and transmits death signals received at the plasma membrane to effector pro-apoptotic proteins at the mitochondrial membrane. BID has the capability of interacting with both pro- and anti-apoptotic proteins, and upon activation by caspase 8, triggers cytochrome c release and mitochondrial apoptosis. Deletion and mutagenesis studies determined that the amphipathic α-helical BH3 segment of pro-apoptotic family members can function as a death domain and thus can represent a critical structural motif for interacting with multidomain apoptotic proteins. Structural studies have shown that the BH3 helix can interact with anti-apoptotic proteins by inserting into a hydrophobic groove formed by the interface of BH1, 2 and 3 domains. Activated BID can be bound and sequestered by anti-apoptotic proteins (e.g., BCL-2 and BCL-XL) and can trigger activation of the pro-apoptotic proteins BAX and BAK, leading to cytochrome c release and a mitochondrial apoptosis program. BAD is also a BH3-domain only pro-apoptotic family member whose expression triggers the activation of BAX/BAK. In contrast to BID, however, BAD displays preferential binding to anti-apoptotic family members, BCL-2 and BCL-$X_L$. Whereas the BAD BH3 domain exhibits high affinity binding to BCL-2, BAD BH3 peptide is unable to activate cytochrome c release from mitochondria in vitro, suggesting that BAD is not a direct activator of BAX/BAK. Mitochondria that over-express BCL-2 are resistant to BID-induced cytochrome c release, but co-treatment with BAD can restore BID sensitivity. Induction of mitochondrial apoptosis by BAD appears to result from either: (1) displacement of BAX/BAK activators, such as BID and BID-like proteins, from the BCL-2/BCL-$X_L$ binding pocket, or (2) selective occupation of the BCL-2/BCL-$X_L$ binding pocket by BAD to prevent sequestration of BID-like proteins by anti-apoptotic proteins. Thus, two classes of BH3-domain only proteins have emerged, BID-like proteins that directly activate mitochondrial apoptosis, and BAD-like proteins, that have the capacity to sensitize mitochondria to BID-like pro-apoptotics by occupying the binding pockets of multidomain anti-apoptotic proteins. Various α-helical domains of BCL-2 family member proteins amenable to the methodology disclosed herein have been disclosed (Walensky et al. (2004), Science 305:1466; and Walensky et al., U.S. Patent Publication No. 2005/0250680, the entire disclosures of which are incorporated herein by reference).

Myeloid cell leukemia 1 (MCL-1) is a protein that inhibits cell death through the binding and inhibition of pro-death factors such as BCL-2 interacting mediator (BIM). When MCL-1 is over-expressed, the rate of cell death in a cell or tissue is reduced. In some embodiments, the peptide sequences are derived from BIM. In some embodiments, a peptidomimetic macrocycle peptide derived from a human BIM peptide can be a peptide comprising 1, 2, 3, 4, 5, 6, 7, 8, 9, 10, 11, 12, 13, 14, 15, 16, 17, 18, 19, 20, 21, or 22 amino acids from a BIM peptide sequence.

In some embodiments, a peptidomimetic macrocycle peptide derived from a human BIM peptide sequence can be a peptide comprising 1, 2, 3, 4, 5, 6, 7, 8, 9, 10, 11, 12, 13, 14, 15, 16, 17, 18, 19, 20, 21, or 22 amino acids that are different from the selected sequences from which the peptide is derived. In some embodiments, a peptidomimetic macrocycle peptide derived from a human BIM peptide sequence can be a peptide comprising a mutation at amino acid position 1, 2, 3, 4, 5, 6, 7, 8, 9, 10, 11, 12, 13, 14, 15, 16, 17, 18, 19, 20, 21, or 22. In some embodiments, mutations are mutations of non-essential amino acids. In some embodiments, mutations are mutations of essential amino acids. In some embodiments, mutations are mutations of hydrophobic amino acids. In some embodiments, mutations are mutations of naturally occurring amino acids. In some embodiments, mutations are mutations to a conservative amino acid. In some embodiments, a peptidomimetic macrocycle peptide derived from a human BIM peptide sequence can be a peptide comprising 1, 2, 3, 4, 5, 6, 7, 8, 9, 10, 11, 12, 13, 14, 15, 16, 17, 18, 19, 20, 21, or 22 amino acid analogues. In some embodiments, a peptidomimetic macrocycle peptide derived from a human BIM peptide sequence can be a peptide comprising 1 or 2 capping groups.

In some embodiments, the peptidomimetic macrocycle comprises a C-terminal truncation of 1, 2, 3, 4, 5, 6, 7, 8, 9, 10, 11, 12, 13, 14, 15, 16, 17, 18, 19, 20, 21, 22, 23, 24, 25, 26, 27, 28, 29 or 30 amino acids from an amino acid sequence of BIM In some embodiments, the peptidomimetic macrocycle comprises a N-terminal truncation of 1, 2, 3, 4, 5, 6, 7, 8, 9, 10, 11, 12, 13, 14, 15, 16, 17, 18, 19, 20, 21, or 22 amino acids from the sequence of BIM.

A non-limiting list of suitable BIM macrocycles for use in the present disclosure are given in Tables 4a and 4b. In Tables 4a and 4b, at the C-terminus, some peptides possess a carboxamide terminus (shown as —$NH_2$); some peptides possess a hydroxyl terminus (shown as —OH); some peptides possess a 5-carboxyfluorescein terminus (shown as –5-FAM); some peptides possess a isobutylamide terminus (shown as —NHiBu); some peptides possess a cyclohexylamide terminus (shown as —NHChx); some peptides possess a cyclohexylmethylamide terminus (shown as —NH-MeChx); some peptides possess a phenethylamide terminus (shown as —NHPe); some peptides possess a n-butylamide terminus (shown as —NHBu); some peptides possess a sec-butylamide terminus (shown as —NHsBu); and some peptides possess an uncapped terminus (shown as no terminal modification).

In Tables 4a and 4b, at the N-terminus, some peptides possess an acetyl terminus (shown as Ac—); some peptides possess a fluorescein isothiocyanate terminus (shown as FITC-); some peptides possess a single-unit polyethylene glycol terminus (shown as dPEG1-); some peptides possess a five-unit polyethylene glycol terminus (shown as dPEG5-); some peptides possess an eleven-unit polyethylene glycol terminus (shown as dPEG11-); some peptides possess a propyl terminus (shown as Pr—); some peptides possess a biotin terminus (shown as Biotin-); some peptides possess a KLH terminus (shown as KLH-); some peptides possess an ovalbumin terminus (shown as OVA-); some peptides possess an uncapped terminus (shown as H—); some peptides possess a isobutyl terminus (shown as iBu-); some peptides possess a decanoyl terminus (shown as Decac-); some peptides possess a benzyl terminus (shown as Bz-); some peptides possess a cyclohexyl terminus (shown as Chx-); some peptides possess a benzyl terminus (shown as Bz-); some peptides possess a Vrl terminus (shown as Vrl-); some peptides possess a HBS terminus (shown as HBS—); some peptides possess a MeIm terminus (shown as MeImC-); some peptides possess a tert-butyl terminus (shown as t-Bu-U—); some peptides possess a nonanoyl terminus (shown as non-U—); some peptides possess a ethyl terminus (shown as Et-U—); some peptides possess a cyclohexyl terminus (shown as Chx-U—); some peptides possess a isopropyl terminus (shown as iPr-U—); some peptides possess a phenyl terminus (shown as Ph-U—); some peptides possess a uric terminus (shown as NH2CO—); some peptides possess a palmitoyl terminus (shown as Pam-); some peptides possess a heptenoic terminus (shown as Hep-); and some peptides possess a 5-carboxytetramethylrhodamine terminus (shown as 5-TAMRA-).

Table 4a shows a list of peptidomimetic macrocycles derived from the MCL-1/BCL-XL/BCL-2-binding helix of BIM that were prepared. Table 4b shows a list of selected peptidomimetic macrocycles from Table 4a. SP-809 was prepared by incorporating an i, i+7 crosslink into the sequence of the linear peptide LP-2. SP-815 was prepared by removal of the two terminal arginine residues and an alanine substitution at position 13 of SP-809. SP-962 was prepared by a homoleucine substitution at position 9 and a F4F at position 17 of SP-815.

In some embodiments, the invention provides a peptidomimetic macrocycle that comprises an amino acid sequence that has at least 60%, 70%, 80%, 90%, 95%, 97%, or 100% identity to any one of the amino acid sequences in Table 4a or 4b.

TABLE 4a

Prepared peptidomimetic macrocycles derived from the MCL-1/ BCL-X1/BCL-2-binding helix of BIM

| SP# | SEQ ID NO: | | | 1 | 2 | 3 | 4 | 5 | 6 | 7 | 8 | 9 | 10 | 11 | 12 | 13 | 14 | 15 |
|---|---|---|---|---|---|---|---|---|---|---|---|---|---|---|---|---|---|---|
| LP2 | 1539 | Ac— | | I | W | I | A | Q | E | L | R | R | I | G | D | E | F | N |
| 808 | 1540 | Ac— | | I | W | I | A | Q | E | L | R | $r8 | I | G | D | E | F | N |
| 809 | 1541 | Ac— | | I | W | I | A | Q | A | L | R | $r8 | I | G | D | E | F | N |
| 810 | 1542 | Ac— | | I | W | I | A | Q | E | L | R | $r8 | I | G | D | E | F | N |
| 812 | 1543 | Ac— | | | W | I | A | Q | A | L | R | $r8 | I | G | D | A | F | N |
| 813 | 1544 | Ac— | | | | I | A | Q | A | L | R | $r8 | I | G | D | A | F | A |
| 814 | 1545 | Ac— | | | | I | A | Q | A | L | R | $r8 | I | G | D | A | F | N |
| 815 | 1546 | Ac— | | I | W | I | A | Q | A | L | R | $r8 | I | G | D | A | F | N |
| 816 | 1547 | Ac— | | | W | I | A | Q | A | L | R | $r8 | I | G | D | A | F | N |
| 817 | 1548 | Ac— | | | | I | A | Q | A | L | R | $r8 | I | G | D | A | F | N |
| 818 | 1549 | Ac— | | | | I | A | A | A | L | R | $r8 | I | G | D | A | F | N |
| 819 | 1550 | Ac— | | | | I | A | Q | A | L | A | $r8 | I | G | D | A | F | N |
| 820 | 1551 | Ac— | | | | I | A | Q | A | L | R | $r8 | I | A | D | A | F | N |
| 821 | 1552 | Ac— | | | | I | A | Q | A | L | R | $r8 | I | G | D | A | A | N |
| 822 | 1553 | Ac— | | | | I | A | Q | A | L | R | $r8 | I | G | D | A | F | N |
| 823 | 1554 | Ac— | | I | $ | I | A | Q | $ | L | R | $r8 | I | G | D | E | F | N |
| 824 | 1555 | Ac— | | I | W | I | A | Q | A | L | R | %r8 | I | G | D | A | F | N |
| 825 | 1556 | Ac— | | I | W | I | A | Q | A | L | R | $r8 | I | G | D | E | F | A |
| 826 | 1557 | Ac— | | I | W | I | A | Q | A | L | R | $r8 | I | G | D | Q | A | N |
| 827 | 1558 | FITC— | Ba | I | W | I | A | Q | A | L | R | $r8 | I | G | D | A | F | N |
| 828 | 1559 | 5-FAM— | Ba | I | W | I | A | Q | A | L | R | $r8 | I | G | D | A | F | N |
| 829 | 1560 | 5-FAM— | Ba | I | W | I | A | Q | A | L | R | $r8 | I | G | D | E | F | N |
| 830 | 1561 | Ac— | | I | A | I | A | Q | A | L | R | $r8 | I | G | D | A | F | N |
| 831 | 1562 | Ac— | | I | W | I | A | Q | A | L | R | $r8 | I | G | D | E | F | N |
| 832 | 1563 | Ac— | | I | W | I | A | Q | A | L | R | $r8 | I | G | D | Q | F | N |
| 833 | 1564 | Ac— | | I | W | I | A | A | A | L | R | $r8 | I | G | D | E | F | N |
| 834 | 1565 | Ac— | | I | W | I | A | A | A | L | R | $r8 | I | G | D | Q | F | N |
| 835 | 1566 | Ac— | | I | W | I | A | A | A | L | R | $r8 | I | G | D | A | F | N |
| 836 | 1567 | Ac— | | I | W | I | A | Q | A | L | R | $r8 | I | G | D | A | F | A |
| 837 | 1568 | Ac— | | I | W | I | A | Q | A | L | Cit | $r8 | I | G | D | A | F | N |
| 838 | 1569 | Ac— | | I | W | I | A | Q | A | L | Cit | $r8 | I | G | D | Q | F | N |
| 839 | 1570 | Ac— | | I | W | I | A | Q | A | L | H | $r8 | I | G | D | A | F | N |
| 840 | 1571 | Ac— | | I | W | I | A | Q | A | L | H | $r8 | I | G | D | Q | F | N |
| 841 | 1572 | Ac— | | I | W | I | A | Q | A | L | Q | $r8 | I | G | D | A | F | N |
| 842 | 1573 | Ac— | | I | W | I | A | Q | A | L | Q | $r8 | I | G | D | Q | F | N |
| 843 | 1574 | Ac— | | I | W | I | A | Q | A | L | R | $r8 | I | G | D | A | A | N |
| 844 | 1575 | Ac— | | I | W | I | A | Q | A | L | R | $r8 | I | G | D | A | I | N |
| 845 | 1576 | Ac— | | I | W | I | A | Q | A | L | R | $r8 | I | G | D | Q | I | N |
| 846 | 1577 | Ac— | | I | W | I | A | Q | A | A | R | $r8 | I | G | D | A | A | N |
| 847 | 1578 | Ac— | | I | W | I | A | Q | A | L | R | $r8 | I | A | D | A | F | N |
| 848 | 1579 | Ac— | | I | W | I | A | Q | A | L | R | $r8 | I | A | D | Q | F | N |
| 849 | 1580 | Ac— | | I | W | I | A | Q | A | L | R | $r8 | A | G | D | A | F | N |
| 850 | 1581 | Ac— | | I | W | I | A | Q | A | L | R | $r8 | A | G | D | Q | F | N |
| 851 | 1582 | Ac— | | I | W | I | A | Q | A | L | R | $r8 | I | G | D | A | F | N |
| 852 | 1583 | Ac— | | I | W | I | A | Q | A | L | R | $r8 | I | G | D | Q | F | N |
| 853 | 1584 | Ac— | | I | W | F | A | Q | A | L | R | $r8 | I | G | D | A | F | N |
| 854 | 1585 | Ac— | | I | W | F | A | Q | A | L | R | $r8 | I | G | D | Q | F | N |
| 855 | 1586 | Ac— | | I | W | I | A | Q | A | L | A | $r8 | I | G | D | A | F | N |
| 856 | 1587 | Ac— | | I | W | I | A | Q | A | L | R | $r8 | I | G | N | A | F | N |
| 857 | 1588 | Ac— | | I | W | I | A | Q | A | A | R | $r8 | I | G | D | A | F | N |
| 858 | 1589 | Ac— | | I | W | I | A | Q | A | L | R | $r8 | I | G | D | Q | F | A |
| 859 | 1590 | Ac— | | I | W | Cha | A | Q | A | L | R | $r8 | I | G | D | A | F | N |
| 860 | 1591 | Ac— | | I | W | hhL | A | Q | A | L | R | $r8 | I | G | D | A | F | N |
| 861 | 1592 | Ac— | | I | W | Adm | A | Q | A | L | R | $r8 | I | G | D | A | F | N |
| 862 | 1593 | Ac— | | I | W | hCha | A | Q | A | L | R | $r8 | I | G | D | A | F | N |
| 863 | 1594 | Ac— | | I | W | hF | A | Q | A | L | R | $r8 | I | G | D | A | F | N |
| 864 | 1595 | Ac— | | I | W | Igl | A | Q | A | L | R | $r8 | I | G | D | A | F | N |
| 865 | 1596 | Ac— | | I | W | F4CF3 | A | Q | A | L | R | $r8 | I | G | D | A | F | N |
| 866 | 1597 | Ac— | | I | W | F4tBu | A | Q | A | L | R | $r8 | I | G | D | A | F | N |
| 867 | 1598 | Ac— | | I | W | 2Nal | A | Q | A | L | R | $r8 | I | G | D | A | F | N |
| 868 | 1599 | Ac— | | I | W | Bip | A | Q | A | L | R | $r8 | I | G | D | A | F | N |
| 869 | 1600 | Ac— | | I | W | I | A | Q | A | Cha | R | $r8 | I | G | D | A | F | N |
| 870 | 1601 | Ac— | | I | W | I | A | Q | A | hhL | R | $r8 | I | G | D | A | F | N |
| 871 | 1602 | Ac— | | I | W | I | A | Q | A | Adm | R | $r8 | I | G | D | A | F | N |
| 872 | 1603 | Ac— | | I | W | I | A | Q | A | hCha | R | $r8 | I | G | D | A | F | N |
| 873 | 1604 | Ac— | | I | W | I | A | Q | A | hAdm | R | $r8 | I | G | D | A | F | N |
| 874 | 1605 | Ac— | | I | W | I | A | Q | A | hF | R | $r8 | I | G | D | A | F | N |

TABLE 4a-continued

Prepared peptidomimetic macrocycles derived from the MCL-1/ BCL-X1/BCL-2-binding helix of BIM

| | | | | | | | | | | | | | | | | |
|---|---|---|---|---|---|---|---|---|---|---|---|---|---|---|---|---|
| 875 | 1606 | Ac— | I | W | I | A | Q | A | Igl | R | $r8 | I | G | D | A | F | N |
| 876 | 1607 | Ac— | I | W | I | A | Q | A | F4CF3 | R | $r8 | I | G | D | A | F | N |
| 877 | 1608 | Ac— | I | W | I | A | Q | A | F4tBu | R | $r8 | I | G | D | A | F | N |
| 878 | 1609 | Ac— | I | W | I | A | Q | A | 2Nal | R | $r8 | I | G | D | A | F | N |
| 879 | 1610 | Ac— | I | W | I | A | Q | A | Bip | R | $r8 | I | G | D | A | F | N |
| 880 | 1611 | Ac— | I | W | I | A | Q | A | L | R | $r8 | Cba | G | D | A | F | N |
| 881 | 1612 | Ac— | I | W | I | A | Q | A | L | R | $r8 | hL | G | D | A | F | N |
| 882 | 1613 | Ac— | I | W | I | A | Q | A | L | R | $r8 | Cha | G | D | A | F | N |
| 883 | 1614 | Ac— | I | W | I | A | Q | A | L | R | $r8 | Tba | G | D | A | F | N |
| 884 | 1615 | Ac— | I | W | I | A | Q | A | L | R | $r8 | hhL | G | D | A | F | N |
| 885 | 1616 | Ac— | I | AmW | I | A | Q | A | L | R | $r8 | I | G | D | A | F | N |
| 886 | 1617 | Ac— | I | Aib | I | A | Q | A | L | R | $r8 | I | G | D | A | F | N |
| 887 | 1618 | Ac— | AmL | W | I | A | Q | A | L | R | $r8 | I | G | D | A | F | N |
| 888 | 1619 | Ac— | I | W | AmL | A | Q | A | L | R | $r8 | I | G | D | A | F | N |
| 889 | 1620 | Ac— | I | W | I | Aib | Q | A | L | R | $r8 | I | G | AmD | A | F | N |
| 890 | 1621 | Ac— | I | W | I | A | Aib | A | L | R | $r8 | I | G | D | A | F | N |
| 891 | 1622 | Ac— | I | W | I | A | Q | A | L | R | $r8 | I | G | AmD | A | F | N |
| 892 | 1623 | Ac— | I | W | I | A | Q | A | L | R | $r8 | I | G | D | A | F | N |
| 896 | 1624 | Ac— | I | W | Tba | A | Q | A | L | R | $r8 | I | G | D | A | F | N |
| 897 | 1625 | Ac— | I | W | hL | A | Q | A | L | R | $r8 | I | G | D | A | F | N |
| 898 | 1626 | Ac— | I | W | Chg | A | Q | A | L | R | $r8 | I | G | D | A | F | N |
| 899 | 1627 | Ac— | I | W | Ac6c | A | Q | A | L | R | $r8 | I | G | D | A | F | N |
| 900 | 1628 | Ac— | I | W | Ac5c | A | Q | A | L | R | $r8 | I | G | D | A | F | N |
| 901 | 1629 | Ac— | E | W | I | A | A | A | L | R | $r8 | I | G | D | A | F | N |
| 902 | 1630 | Ac— | R | W | I | A | A | A | L | R | $r8 | I | G | D | A | F | N |
| 903 | 1631 | Ac— | K | W | I | A | A | A | L | R | $r8 | I | G | D | A | F | N |
| 904 | 1632 | Ac— | H | W | I | A | A | A | L | R | $r8 | I | G | D | A | F | N |
| 905 | 1633 | Ac— | S | W | I | A | A | A | L | R | $r8 | I | G | D | A | F | N |
| 906 | 1634 | Ac— | Q | W | I | A | A | A | L | R | $r8 | I | G | D | A | F | N |
| 907 | 1635 | Ac— | A | W | I | A | A | A | L | R | $r8 | I | G | D | A | F | N |
| 908 | 1636 | Ac— | Aib | W | I | A | A | A | L | R | $r8 | I | G | D | A | F | N |
| 909 | 1637 | Ac— | F | W | I | A | A | A | L | R | $r8 | I | G | D | A | F | N |
| 910 | 1638 | Ac— | I | D | I | A | A | A | L | R | $r8 | I | G | D | A | F | N |
| 911 | 1639 | Ac— | I | R | I | A | A | A | L | R | $r8 | I | G | D | A | F | N |
| 912 | 1640 | Ac— | I | H | I | A | A | A | L | R | $r8 | I | G | D | A | F | N |
| 913 | 1641 | Ac— | I | S | I | A | A | A | L | R | $r8 | I | G | D | A | F | N |
| 914 | 1642 | Ac— | I | N | I | A | A | A | L | R | $r8 | I | G | D | A | F | N |
| 915 | 1643 | Ac— | I | L | I | A | A | A | L | R | $r8 | I | G | D | A | F | N |
| 916 | 1644 | Ac— | I | F | I | A | A | A | L | R | $r8 | I | G | D | A | F | N |
| 917 | 1645 | Ac— | I | 2Nal | I | A | A | A | L | R | $r8 | I | G | D | A | F | N |
| 918 | 1646 | Ac— | I | W | I | S | A | A | L | R | $r8 | I | G | D | A | F | N |
| 919 | 1647 | Ac— | I | W | I | L | A | A | L | R | $r8 | I | G | D | A | F | N |
| 920 | 1648 | Ac— | I | W | I | F | A | A | L | R | $r8 | I | G | D | A | F | N |
| 921 | 1649 | Ac— | I | W | I | A | L | A | L | R | $r8 | I | G | D | A | F | N |
| 922 | 1650 | Ac— | I | W | I | A | A | A | L | K | $r8 | I | G | D | A | F | N |
| 923 | 1651 | Ac— | I | W | I | A | A | A | L | R | $r8 | I | Abu | D | A | F | N |
| 924 | 1652 | Ac— | I | W | I | A | A | A | L | R | $r8 | I | V | D | A | F | N |
| 925 | 1653 | Ac— | I | W | I | A | A | A | L | R | $r8 | I | G | E | A | F | N |
| 926 | 1654 | Ac— | I | W | I | A | A | A | L | R | $r8 | I | G | D | A | G | N |
| 927 | 1655 | Ac— | I | W | I | A | Q | A | L | R | $r8 | I | G | D | A | W | N |
| 928 | 1656 | Ac— | I | W | I | A | Q | A | L | R | $r8 | I | G | D | A | hF | N |
| 929 | 1657 | Ac— | I | W | I | A | Q | A | L | R | $r8 | I | G | D | A | F4CF3 | N |
| 930 | 1658 | Ac— | I | W | I | A | Q | A | L | R | $r8 | I | G | D | A | F4tBu | N |
| 931 | 1659 | Ac— | I | W | I | A | Q | A | L | R | $r8 | I | G | D | A | 2Nal | N |
| 932 | 1660 | Ac— | I | W | I | A | Q | A | L | R | $r8 | I | G | D | A | Bip | N |
| 933 | 1661 | Ac— | I | W | I | A | A | A | L | R | $r8 | I | G | D | A | F | D |
| 934 | 1662 | Ac— | I | W | I | A | A | A | L | R | $r8 | I | G | D | A | F | E |
| 935 | 1663 | Ac— | I | W | I | A | A | A | L | R | $r8 | I | G | D | A | F | Q |
| 936 | 1664 | Ac— | I | W | I | A | A | A | L | R | $r8 | I | G | D | A | F | S |
| 937 | 1665 | Ac— | I | W | I | A | A | A | L | R | $r8 | I | G | D | A | F | H |
| 938 | 1666 | Ac— | I | W | I | A | A | A | L | R | $r8 | I | G | D | A | F | N |
| 939 | 1667 | Ac— | I | W | I | A | Q | A | L | R | $r8 | I | G | D | A | F | N |
| 940 | 1668 | Ac— | I | W | I | A | Q | A | L | R | $r8 | I | G | D | A | F | N |
| 941 | 1669 | Ac— | I | W | I | A | Q | A | L | R | $r8 | I | G | D | A | F | N |
| 942 | 1670 | Ac— | I | W | I | A | Q | A | L | R | $r8 | I | G | D | A | F | N |
| 943 | 1671 | Ac— | I | W | I | A | Q | A | L | R | $r8 | I | G | D | A | F | N |
| 944 | 1672 | Ac— | I | W | I | A | Q | A | L | R | $r8 | I | G | D | A | F | N |
| 945 | 1673 | Ac— | I | W | I | A | A | A | L | R | $r8 | I | G | AmD | A | F | N |
| 946 | 1674 | Ac— | I | W | I | A | A | A | L | R | $r8 | I | G | D | A | F | N |
| 947 | 1675 | Ac— | I | W | I | A | A | A | L | R | $r8 | I | G | D | A | F | N |
| 948 | 1676 | Ac— | I | W | I | A | A | A | L | R | $r8 | I | G | D | A | F | N |
| 949 | 1677 | Ac— | I | W | I | A | A | A | L | R | $r8 | I | G | D | A | F | N |
| 950 | 1678 | Ac— | I | W | I | A | A | A | L | R | $r8 | I | G | D | A | F | N |
| 951 | 1679 | Ac— | I | W | I | A | A | A | L | R | $r8 | I | G | D | A | F | N |
| 952 | 1680 | Ac— | I | W | I | A | Q | A | AmL | R | $r8 | I | G | D | A | F | N |
| 953 | 1681 | Ac— | I | W | I | A | Q | A | L | R | $r8 | I | G | AmD | A | F | N |
| 954 | 1682 | Ac— | I | W | I | A | Q | A | L | R | $r8 | I | G | D | A | F | N |
| 955 | 1683 | Ac— | I | W | I | A | Q | A | L | R | $r8 | I | G | D | A | F | N |

TABLE 4a-continued

Prepared peptidomimetic macrocycles derived from the MCL-1/ BCL-X1/BCL-2-binding helix of BIM

| | | | | | | | | | | | | | | | | | |
|---|---|---|---|---|---|---|---|---|---|---|---|---|---|---|---|---|---|
| 956 | 1684 | Ac— | | I | W | I | A | Q | A | A | Cit | $r8 | I | G | D | A | F | N |
| 957 | 1685 | Ac— | | I | W | I | A | Q | A | L | Cit | $r8 | I | G | N | A | F | N |
| 958 | 1686 | Ac— | | I | W | I | A | Q | A | L | Cit | $r8 | I | G | D | A | A | N |
| 959 | 1687 | Ac— | | I | W | I | A | Q | A | L | Cit | $r8 | I | G | D | A | V | N |
| 960 | 1688 | Ac— | | I | W | I | A | Q | A | L | R | $r8 | I | G | D | A | F | N |
| 961 | 1689 | Ac— | | I | W | I | A | Q | A | L | R | $r8 | hL | G | D | A | F | N |
| 962 | 1690 | Ac— | | I | W | I | A | Q | A | L | R | $r8 | hL | G | D | A | F | N |
| 963 | 1691 | Ac— | | I | W | I | A | Q | A | L | R | $r8 | hL | G | D | A | F | N |
| 964 | 1692 | Ac— | | A | W | I | A | A | A | L | R | $r8 | hL | G | D | A | F | N |
| 965 | 1693 | Ac— | | A | W | I | A | A | A | L | R | $r8 | hL | G | D | A | F | N |
| 966 | 1694 | Ac— | | I | W | I | A | Q | A | A | R | $r8 | hL | G | D | A | F | N |
| 893 | 1695 | Ac— | | I | $r8 | I | A | Q | A | L | R | St | I | G | D | E | F | N |
| 894 | 1696 | Ac— | | I | W | I | A | $ | A | L | R | St | I | G | D | E | F | N |
| 895 | 1697 | Ac— | | I | W | I | A | Q | A | L | R | $r8 | I | G | D | E | F | N |

| SP# | | | 16 | 17 | 18 | 19 | 20 | 21 | | Calc (M + 2)/2 | Found Mass |
|---|---|---|---|---|---|---|---|---|---|---|---|
| LP2 | Ac— | | A | Y | Y | A | R | R | —NH$_2$ | | |
| 808 | Ac— | | $ | Y | Y | A | R | R | —NH$_2$ | | |
| 809 | Ac— | | $ | Y | Y | A | R | R | —NH$_2$ | 1344.74 | 1345.7 |
| 810 | Ac— | | $ | Y | Y | A | R | R | —NH$_2$ | 1373.75 | 1373.56 |
| 812 | Ac— | | $ | Y | Y | A | | | —NH$_2$ | 1103.1 | 1103.12 |
| 813 | Ac— | | $ | Y | Y | A | | | —NH$_2$ | 988.55 | 988.45 |
| 814 | Ac— | | $ | Y | A | A | | | —NH$_2$ | 964.04 | 963.94 |
| 815 | Ac— | | $ | Y | Y | A | | | —NH$_2$ | 1159.64 | 1159.87 |
| 816 | Ac— | | $ | Y | Y | A | | | —NH$_2$ | 1103.1 | 1102.94 |
| 817 | Ac— | | $ | Y | Y | A | | | —NH$_2$ | 1010.06 | 1009.9 |
| 818 | Ac— | | $ | Y | Y | A | | | —NH$_2$ | 981.55 | 981.86 |
| 819 | Ac— | | $ | Y | Y | A | | | —NH$_2$ | 967.53 | 967.45 |
| 820 | Ac— | | $ | Y | Y | A | | | —NH$_2$ | 1017.07 | 1016.93 |
| 821 | Ac— | | $ | Y | Y | A | | | —NH$_2$ | 972.04 | 971.89 |
| 822 | Ac— | | $ | A | Y | A | | | —NH$_2$ | 964.04 | 963.94 |
| 823 | Ac— | | $ | Y | Y | A | | | —NH$_2$ | 1185.17 | 1185.61 |
| 824 | Ac— | | % | Y | Y | A | | | —NH$_2$ | 1160.14 | 1161.28 |
| 825 | Ac— | | $ | Y | Y | A | | | —NH$_2$ | 1167.14 | 1168.2 |
| 826 | Ac— | | $ | Y | Y | A | | | —NH$_2$ | 1150.13 | 1151.09 |
| 827 | FITC— | Ba | $ | Y | Y | A | | | —NH$_2$ | 1368.67 | 1369.79 |
| 828 | 5-FAM— | Ba | $ | Y | Y | A | | | —NH$_2$ | 1353.18 | 1354.13 |
| 829 | 5-FAM— | Ba | $ | Y | Y | A | | | —NH$_2$ | 1382.18 | 1382.99 |
| 830 | Ac— | | $ | Y | Y | A | | | —NH$_2$ | 1102.12 | 1103.17 |
| 831 | Ac— | | $ | Y | Y | A | | | —NH$_2$ | 1188.64 | 1189.57 |
| 832 | Ac— | | $ | Y | Y | A | | | —NH$_2$ | 1188.15 | 1189.1 |
| 833 | Ac— | | $ | Y | Y | A | | | —NH$_2$ | 1160.13 | 1161.17 |
| 834 | Ac— | | $ | Y | Y | A | | | —NH$_2$ | 1159.64 | 1160.34 |
| 835 | Ac— | | $ | Y | Y | A | | | —NH$_2$ | 1131.13 | 1132.12 |
| 836 | Ac— | | $ | Y | Y | A | | | —NH$_2$ | 1138.14 | 1139.15 |
| 837 | Ac— | | $ | Y | Y | A | | | —NH$_2$ | 1160.13 | 1160.98 |
| 838 | Ac— | | $ | Y | Y | A | | | —NH$_2$ | 1188.64 | 1189.66 |
| 839 | Ac— | | $ | Y | Y | A | | | —NH$_2$ | 1150.12 | 1151.09 |
| 840 | Ac— | | $ | Y | Y | A | | | —NH$_2$ | 1178.63 | 1179.67 |
| 841 | Ac— | | $ | Y | Y | A | | | —NH$_2$ | 1145.62 | 1146.55 |
| 842 | Ac— | | $ | Y | Y | A | | | —NH$_2$ | 1174.13 | 1175.14 |
| 843 | Ac— | | $ | Y | Y | A | | | —NH$_2$ | 1121.62 | 1122.5 |
| 844 | Ac— | | $ | Y | Y | A | | | —NH$_2$ | 1142.65 | 1143.59 |
| 845 | Ac— | | $ | Y | Y | A | | | —NH$_2$ | 1171.16 | 1171.9 |
| 846 | Ac— | | $ | Y | Y | A | | | —NH$_2$ | 1100.6 | 1101.5 |
| 847 | Ac— | | $ | Y | Y | A | | | —NH$_2$ | 1166.65 | 1167.83 |
| 848 | Ac— | | $ | Y | Y | A | | | —NH$_2$ | 1195.16 | 1196.23 |
| 849 | Ac— | | $ | Y | Y | A | | | —NH$_2$ | 1138.62 | 1139.61 |
| 850 | Ac— | | $ | Y | Y | A | | | —NH$_2$ | 1167.13 | 1168.11 |
| 851 | Ac— | | $ | Y | Y | A | | | —NH$_2$ | 1176.63 | 1177.63 |
| 852 | Ac— | | $ | Y | Y | A | | | —NH$_2$ | 1205.14 | 1205.94 |
| 853 | Ac— | | $ | Y | Y | A | | | —NH$_2$ | 1176.63 | 1177.63 |
| 854 | Ac— | | $ | Y | Y | A | | | —NH$_2$ | 1205.14 | 1206.13 |
| 855 | Ac— | | $ | Y | Y | A | | | —NH$_2$ | 1117.11 | 1118.15 |
| 856 | Ac— | | $ | Y | Y | A | | | —NH$_2$ | 1159.15 | 1159.63 |
| 857 | Ac— | | $ | Y | Y | A | | | —NH$_2$ | 1138.62 | 1139.2 |
| 858 | Ac— | | $ | Y | Y | A | | | —NH$_2$ | 1166.65 | 1167.3 |
| 859 | Ac— | | $ | Y | Y | A | | | —NH$_2$ | 1179.65 | 1180.15 |
| 860 | Ac— | | $ | Y | Y | A | | | —NH$_2$ | 1173.65 | 1174.39 |
| 861 | Ac— | | $ | Y | Y | A | | | —NH$_2$ | 1198.66 | 1199.28 |
| 862 | Ac— | | $ | Y | Y | A | | | —NH$_2$ | 1186.66 | 1186.98 |
| 863 | Ac— | | $ | Y | Y | A | | | —NH$_2$ | 1183.64 | 1184.48 |
| 864 | Ac— | | $ | Y | Y | A | | | —NH$_2$ | 1190.65 | 1190.41 |
| 865 | Ac— | | $ | Y | Y | A | | | —NH$_2$ | 1210.62 | 1211.31 |
| 866 | Ac— | | $ | Y | Y | A | | | —NH$_2$ | 1204.66 | 1205.39 |
| 867 | Ac— | | $ | Y | Y | A | | | —NH$_2$ | 1201.64 | 1202.2 |
| 868 | Ac— | | $ | Y | Y | A | | | —NH$_2$ | 1214.65 | 1215.43 |

TABLE 4a-continued

Prepared peptidomimetic macrocycles derived from the MCL-1/ BCL-X1/BCL-2-binding helix of BIM

| | | | | | | | | |
|---|---|---|---|---|---|---|---|---|
| 869 | Ac— | $ | Y | Y | A | —NH$_2$ | 1179.65 | 1180.22 |
| 870 | Ac— | $ | Y | Y | A | —NH$_2$ | 1173.65 | 1174.4 |
| 871 | Ac— | $ | Y | Y | A | —NH$_2$ | 1198.66 | 1199.05 |
| 872 | Ac— | $ | Y | Y | A | —NH$_2$ | 1186.66 | 1187.25 |
| 873 | Ac— | $ | Y | Y | A | —NH$_2$ | 1205.67 | 1206.4 |
| 874 | Ac— | $ | Y | Y | A | —NH$_2$ | 1183.64 | 1184.29 |
| 875 | Ac— | $ | Y | Y | A | —NH$_2$ | 1190.65 | 1190.4 |
| 876 | Ac— | $ | Y | Y | A | —NH$_2$ | 1210.62 | 1210.94 |
| 877 | Ac— | $ | Y | Y | A | —NH$_2$ | 1204.66 | 1205.29 |
| 878 | Ac— | $ | Y | Y | A | —NH$_2$ | 1201.64 | 1202.15 |
| 879 | Ac— | $ | Y | Y | A | —NH$_2$ | 1214.65 | 1214.91 |
| 880 | Ac— | $ | Y | Y | A | —NH$_2$ | 1165.64 | 1166.07 |
| 881 | Ac— | $ | Y | Y | A | —NH$_2$ | 1166.65 | 1167.37 |
| 882 | Ac— | $ | Y | Y | A | —NH$_2$ | 1179.65 | 1180.22 |
| 883 | Ac— | $ | Y | Y | A | —NH$_2$ | 1166.65 | 1167.18 |
| 884 | Ac— | $ | Y | Y | A | —NH$_2$ | 1173.65 | 1173.93 |
| 885 | Ac— | $ | Y | Y | A | —NH$_2$ | 1166.65 | 1167.18 |
| 886 | Ac— | $ | Y | Y | A | —NH$_2$ | 1109.13 | 1109.46 |
| 887 | Ac— | $ | Y | Y | A | —NH$_2$ | 1166.65 | 1167.27 |
| 888 | Ac— | $ | Y | Y | A | —NH$_2$ | 1166.65 | 1137.37 |
| 889 | Ac— | $ | Y | Y | A | —NH$_2$ | 1173.65 | 1173.93 |
| 890 | Ac— | $ | Y | Y | A | —NH$_2$ | 1138.14 | 1138.32 |
| 891 | Ac— | $ | Y | Y | A | —NH$_2$ | 1166.65 | 1167.37 |
| 892 | Ac— | $ | Y | F4F | A | —NH$_2$ | 1160.64 | 1161.45 |
| 896 | Ac— | $ | Y | Y | A | —NH$_2$ | 1166.65 | 1167.37 |
| 897 | Ac— | $ | Y | Y | A | —NH$_2$ | 1166.65 | 1167.37 |
| 898 | Ac— | $ | Y | Y | A | —NH$_2$ | 1172.65 | 1173.47 |
| 899 | Ac— | $ | Y | Y | A | —NH$_2$ | 1165.64 | 1166.44 |
| 900 | Ac— | $ | Y | Y | A | —NH$_2$ | 1158.63 | 1159.32 |
| 901 | Ac— | $ | Y | Y | A | —NH$_2$ | 1139.11 | 1139.52 |
| 902 | Ac— | $ | Y | Y | A | —NH$_2$ | 1152.64 | 1153.49 |
| 903 | Ac— | $ | Y | Y | A | —NH$_2$ | 1138.63 | 1138.97 |
| 904 | Ac— | $ | Y | Y | A | —NH$_2$ | 1143.12 | 1143.87 |
| 905 | Ac— | $ | Y | Y | A | —NH$_2$ | 1118.1 | 1118.8 |
| 906 | Ac— | $ | Y | Y | A | —NH$_2$ | 1138.62 | 1139.24 |
| 907 | Ac— | $ | Y | Y | A | —NH$_2$ | 1110.1 | 1110.75 |
| 908 | Ac— | $ | Y | Y | A | —NH$_2$ | 1117.11 | 1117.78 |
| 909 | Ac— | $ | Y | Y | A | —NH$_2$ | 1148.12 | 1148.96 |
| 910 | Ac— | $ | Y | Y | A | —NH$_2$ | 1095.6 | 1096.32 |
| 911 | Ac— | $ | Y | Y | A | —NH$_2$ | 1116.14 | 1116.95 |
| 912 | Ac— | $ | Y | Y | A | —NH$_2$ | 1106.62 | 1107.24 |
| 913 | Ac— | $ | Y | Y | A | —NH$_2$ | 1081.6 | 1181.98 |
| 914 | Ac— | $ | Y | Y | A | —NH$_2$ | 1095.11 | 1095.58 |
| 915 | Ac— | $ | Y | Y | A | —NH$_2$ | 1094.63 | 1095.3 |
| 916 | Ac— | $ | Y | Y | A | —NH$_2$ | 1111.62 | 1112.33 |
| 917 | Ac— | $ | Y | Y | A | —NH$_2$ | 1136.63 | 1137.3 |
| 918 | Ac— | $ | Y | Y | A | —NH$_2$ | 1139.13 | 1139.89 |
| 919 | Ac— | $ | Y | Y | A | —NH$_2$ | 1152.15 | 1152.94 |
| 920 | Ac— | $ | Y | Y | A | —NH$_2$ | 1169.14 | 1169.86 |
| 921 | Ac— | $ | Y | Y | A | —NH$_2$ | 1152.15 | 1152.84 |
| 922 | Ac— | $ | Y | Y | A | —NH$_2$ | 1117.13 | 1117.97 |
| 923 | Ac— | $ | Y | Y | A | —NH$_2$ | 1145.14 | 1145.9 |
| 924 | Ac— | $ | Y | Y | A | —NH$_2$ | 1152.15 | 1152.94 |
| 925 | Ac— | $ | Y | Y | A | —NH$_2$ | 1138.14 | 1138.87 |
| 926 | Ac— | $ | Y | Y | A | —NH$_2$ | 1086.1 | 1086.89 |
| 927 | Ac— | $ | Y | Y | A | —NH$_2$ | 1179.14 | 1180.04 |
| 928 | Ac— | $ | Y | Y | A | —NH$_2$ | 1166.65 | 1167.46 |
| 929 | Ac— | $ | Y | Y | A | —NH$_2$ | 1193.63 | 1194.38 |
| 930 | Ac— | $ | Y | Y | A | —NH$_2$ | 1187.67 | 1188.36 |
| 931 | Ac— | $ | Y | Y | A | —NH$_2$ | 1184.65 | 1185.5 |
| 932 | Ac— | $ | Y | Y | A | —NH$_2$ | 1197.65 | 1198.54 |
| 933 | Ac— | $ | Y | Y | A | —NH$_2$ | 1131.62 | 1132.4 |
| 934 | Ac— | $ | Y | Y | A | —NH$_2$ | 1138.63 | 1139.02 |
| 935 | Ac— | $ | Y | Y | A | —NH$_2$ | 1138.14 | 1138.84 |
| 936 | Ac— | $ | Y | Y | A | —NH$_2$ | 1117.62 | 1118.5 |
| 937 | Ac— | $ | Y | Y | A | —NH$_2$ | 1142.64 | 1143.25 |
| 938 | Ac— | $ | L | Y | A | —NH$_2$ | 1106.14 | 1107.05 |
| 939 | Ac— | $ | Y | A | A | —NH$_2$ | 1113.63 | 1114.27 |
| 940 | Ac— | $ | Y | L | A | —NH$_2$ | 1134.65 | 1135.33 |
| 941 | Ac— | $ | Y | Cha | A | —NH$_2$ | 1154.66 | 1155.31 |
| 942 | Ac— | $ | Y | hF | A | —NH$_2$ | 1158.65 | 1159.5 |
| 943 | Ac— | $ | Y | W | A | —NH$_2$ | 1171.15 | 1171.78 |
| 944 | Ac— | $ | Y | 2Nal | A | —NH$_2$ | 1176.65 | 1177 |
| 945 | Ac— | $ | Y | Y | D | —NH$_2$ | 1153.12 | 1153.77 |
| 946 | Ac— | $ | Y | Y | E | —NH$_2$ | 1160.13 | 1160.8 |
| 947 | Ac— | $ | Y | Y | Q | —NH$_2$ | 1159.64 | 1160.26 |
| 948 | Ac— | $ | Y | Y | S | —NH$_2$ | 1139.13 | 1139.47 |
| 949 | Ac— | $ | Y | Y | H | —NH$_2$ | 1164.14 | 1165.05 |

TABLE 4a-continued

Prepared peptidomimetic macrocycles derived from the MCL-1/ BCL-X1/BCL-2-binding helix of BIM

| | | | | | | | | | | |
|---|---|---|---|---|---|---|---|---|---|---|
| 950 | Ac— | $ | Y | Y | R | | | —NH$_2$ | 1173.66 | 1174.4 |
| 951 | Ac— | $ | Y | Y | K | | | —NH$_2$ | 1159.66 | 1160.26 |
| 952 | Ac— | $ | Y | Y | A | | | —NH$_2$ | 1166.65 | 1167.18 |
| 953 | Ac— | $ | Y | Y | A | | | —NH$_2$ | 1166.65 | 1167.46 |
| 954 | Ac— | $ | F4F | Y | A | | | —NH$_2$ | 1160.64 | 1161.26 |
| 955 | Ac— | $ | Y | Y | Aib | | | —NH$_2$ | 1166.65 | 1167.46 |
| 956 | Ac— | $ | Y | Y | A | | | —NH$_2$ | 1139.11 | 1139.71 |
| 957 | Ac— | $ | Y | Y | A | | | —NH$_2$ | 1159.64 | 1160.4 |
| 958 | Ac— | $ | Y | Y | A | | | —NH$_2$ | 1122.12 | 1122.87 |
| 959 | Ac— | $ | Y | Y | A | | | —NH$_2$ | 1136.13 | 1136.47 |
| 960 | Ac— | $ | A | Y | A | | | —NH$_2$ | 1113.63 | 1113.9 |
| 961 | Ac— | $ | F4F | Y | A | | | —NH$_2$ | 1167.64 | 1168.57 |
| 962 | Ac— | $ | Y | F4F | A | | | —NH$_2$ | 1167.64 | 1168.2 |
| 963 | Ac— | $ | F4F | F4F | A | | | —NH$_2$ | 1168.64 | 1169.59 |
| 964 | Ac— | $ | Y | F4F | A | | | —NH$_2$ | 1118.11 | 1118.89 |
| 965 | Ac— | $ | A | F4F | A | | | —NH$_2$ | 1072.1 | 1072.92 |
| 966 | Ac— | $ | F4F | F4F | A | | | —NH$_2$ | 1147.62 | 1148.59 |
| 893 | Ac— | $s8 | Y | Y | A | | | —NH$_2$ | 1199.18 | 1199.74 |
| 894 | Ac— | $s8 | Y | Y | A | | | —NH$_2$ | 1207.17 | 1207.7 |
| 895 | Ac— | St | Y | Y | A | $r5 | A | —NH$_2$ | 1306.72 | 1307.42 |

TABLE 4b

Selected peptidomimetic macrocycles derived from the MCL-1/ BCL-XL/BC$_L$-2-binding helix of BIM.

| | | | | | IC$_{50}$ (nM) | | Raji Cell |
|---|---|---|---|---|---|---|---|
| SP# | Ch | L | VH | RT (min)* | Ala (%) | MCL-1 BCL-X$_L$ | Viability EC$_{50}$ (µM)** |
| 810 | 0 | 21 | 18.9 | 9.07 | 9.5 | ND    9.2 | >30 |
| 809 | 1 | 21 | 16.5 | 10.56 | 14.3 | 10.6   3.9 | >30 |
| 815 | 0 | 19 | 9.1 | 15.07 | 21 | 8.4   22.4 | 6.6 |
| 962 | 0 | 19 | 8.3 | 17.69 | 21 | 27.0   13.0 | 0.7 |

*See Example 11 table
**5% serum, 48 hr
Ch = net charge;
L = length in amino acids;
VH = von Heijne;
RT = retention time;
Ala = alanine content Preparation of Peptidomimetic Macrocycles Peptidomimetic macrocycles can be prepared by any of a variety of methods known in the art. For example, any of the residues indicated by "$" or "$r8" in Table 1, Table 1a, Table 1b, or Table 1c can be substituted with a residue capable of forming a crosslinker with a second residue in the same molecule or a precursor of such a residue.

Various methods to effect formation of peptidomimetic macrocycles are known in the art. For example, the preparation of peptidomimetic macrocycles of Formula I is described in Schafmeister et al., J. Am. Chem. Soc. 122: 5891-5892 (2000); Schafmeister & Verdine, J. Am. Chem. Soc. 122:5891 (2005); Walensky et al., Science 305:1466-1470 (2004); U.S. Pat. No. 7,192,713 and PCT application WO 2008/121767. The α,α-disubstituted amino acids and amino acid precursors disclosed in the cited references can be employed in synthesis of the peptidomimetic macrocycle precursor polypeptides. For example, the "S5-olefin amino acid" is (S)-α-(2'-pentenyl) alanine and the "R$_8$ olefin amino acid" is (R)-α-(2'-octenyl) alanine. Following incorporation of such amino acids into precursor polypeptides, the terminal olefins are reacted with a metathesis catalyst, leading to the formation of the peptidomimetic macrocycle. In various embodiments, the following amino acids can be employed in the synthesis of the peptidomimetic macrocycle:

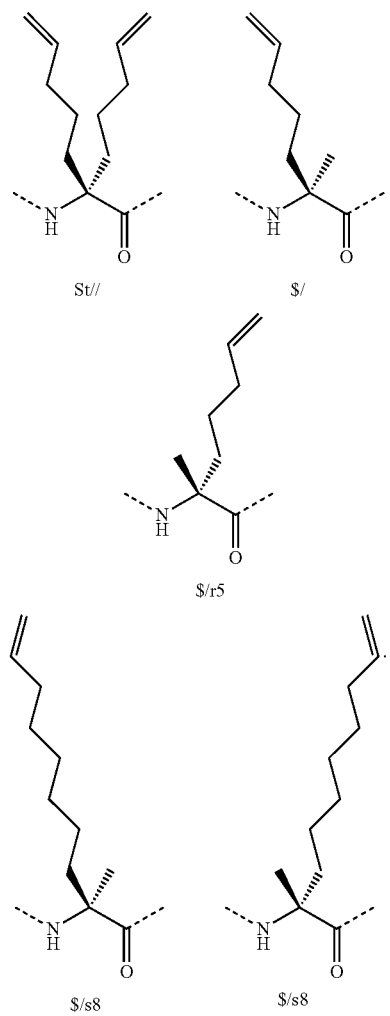

In other embodiments, the peptidomimetic macrocycles are of Formula N or Na. Methods for the preparation of such macrocycles are described, for example, in U.S. Pat. No. 7,202,332.

Additional methods of forming peptidomimetic macrocycles which are envisioned as suitable include those disclosed by Mustapa, M. Firouz Mohd et al., J. Org. Chem (2003), 68, pp. 8193-8198; Yang, Bin et al. Bioorg Med. Chem. Lett. (2004), 14, pp. 1403-1406; U.S. Pat. Nos. 5,364,851; 5,446,128; 5,824,483; 6,713,280; and 7,202,332. In such embodiments, amino acid precursors are used containing an additional substituent R— at the alpha position. Such amino acids are incorporated into the macrocycle precursor at the desired positions, which can be at the positions where the crosslinker is substituted or, alternatively, elsewhere in the sequence of the macrocycle precursor. Cyclization of the precursor is then effected according to the indicated method.

Assays

The properties of peptidomimetic macrocycles are assayed, for example, by using the methods described below. In some embodiments, a peptidomimetic macrocycle has improved biological properties relative to a corresponding polypeptide lacking the substituents described herein.

A peptidomimetic macrocycle with enhanced cell penetrability can be prepared based on one or more properties of the polypeptide. In some embodiments, a peptidomimetic macrocycle with enhanced cell penetrability can be prepared based on a length of the amino acid sequence of the polypeptide. In some embodiments, a peptidomimetic macrocycle with enhanced cell penetrability can be prepared based on a von Heijne value of the polypeptide. In some embodiments, a peptidomimetic macrocycle with enhanced cell penetrability can be prepared based on a net charge carried by the polypeptide.

In some embodiments, a peptidomimetic macrocycle with enhanced cell penetrability can be prepared based on an alanine content in the amino acid sequence of the polypeptide. In some embodiments, a peptidomimetic macrocycle with enhanced cell penetrability can be prepared based on an amphipathicity of the polypeptide. In some embodiments, a peptidomimetic macrocycle with enhanced cell penetrability can be prepared based on a solubility of the polypeptide. In some embodiments, a peptidomimetic macrocycle with enhanced cell penetrability can be prepared based on a reverse-phase HPLC retention time of the polypeptide. In some embodiments, a peptidomimetic macrocycle with enhanced cell penetrability can be prepared based on a length of the amino acid sequence of the polypeptide, a von Heijne value of the polypeptide, a net charge carried by the polypeptide, an alanine content in the amino acid sequence of the polypeptide, an amphipathicity of the polypeptide, a solubility of the polypeptide, a reverse-phase HPLC retention time of the polypeptide, or any combination thereof.

A peptidomimetic macrocycle with enhanced cell penetrability can be prepared based on the length of the polypeptide. In some embodiments, the length of the prepared peptidomimetic macrocycle ranges from 10-24 amino acids. For example, the length of the prepared peptidomimetic macrocycle is 10 amino acids, 11 amino acids, 12 amino acids, 13 amino acids, 14 amino acids, 15 amino acids, 16 amino acids, 17 amino acids, 18 amino acids, 19 amino acids, 20 amino acids, 21 amino acids, 22 amino acids, 23 amino acids, or 24 amino acids. For example, the length of the prepared peptidomimetic macrocycle ranges from 10-23, 10-22, 10-21, 10-20, 10-19, 10-18, 10-17, 10-16, 10-15, 10-14, 10-13, or 10-12 amino acids. For example, the length of the prepared peptidomimetic macrocycle ranges from 11-24, 12-24, 13-24, 14-24, 15-24, 16-24, 17-24, 18-24, 19-24, 20-24, 21-24, or 22-24 amino acids. In some embodiments, the length of the prepared peptidomimetic macrocycle ranges from 11 amino acids to 23 amino acids. For example, the length of the prepared peptidomimetic macrocycle ranges from 11-22, 11-21, 11-20, 11-19, 11-18, 11-17, 11-16, 11-15, 11-14, or 11-13 amino acids. For example, the length of the prepared peptidomimetic macrocycle ranges from 12-23, 13-23, 14-23, 15-23, 16-23, 17-23, 18-23, 19-23, 20-23, or 21-23 amino acids. In some embodiments, the length of the prepared peptidomimetic macrocycle ranges from 12 amino acids to 22 amino acids. For example, the length of the prepared peptidomimetic macrocycle ranges from 12-21, 12-20, 12-19, 12-18, 12-17, 12-16, 12-15, or 12-14 amino acids. For example, the length of the prepared peptidomimetic macrocycle ranges from 13-22, 14-22, 15-22, 16-22, 17-22, 18-22, 19-22, or 20-22 amino acids. In some embodiments, the length of the prepared peptidomimetic macrocycle ranges from 13 amino acids to 21 amino acids. For example, the length of the prepared peptidomimetic macrocycle ranges from 13-20, 13-19, 13-18, 13-17, 13-16, or 13-15 amino acids. For example, the length of the prepared peptidomimetic macrocycle ranges from 14-21, 15-21, 16-21, 17-21, 18-21, or 19-21 amino acids. In some embodiments, the length of the prepared peptidomimetic macrocycle ranges from 14 amino acids to 20 amino acids. For example, the length of the prepared peptidomimetic macrocycle ranges from –19, 14-18, 14-17, or 14-16 amino acids. For example, the length of the prepared peptidomimetic macrocycle ranges from 15-20, 16-20, 17-20, or 18-20 amino acids. In some embodiments, the length of the prepared peptidomimetic macrocycle ranges from 15 amino acids to 19 amino acids. For example, the length of the prepared peptidomimetic macrocycle ranges from 15-18 or 15-17 amino acids. For example, the length of the prepared peptidomimetic macrocycle ranges from 16-19 or 17-19 amino acids. In some embodiments, the length of the prepared peptidomimetic macrocycle ranges from 16 amino acids to 18 amino acids. For example, the length of the prepared peptidomimetic macrocycle is 17. In some embodiments, the length of the prepared peptidomimetic macrocycle is 14. In some embodiments, the length of the prepared peptidomimetic macrocycle is 15. In some embodiments, the length of the prepared peptidomimetic macrocycle is 16. In some embodiments, the length of the prepared peptidomimetic macrocycle is 17. In some embodiments, the length of the prepared peptidomimetic macrocycle is 18. In some embodiments, the length of the prepared peptidomimetic macrocycle is 19. In some embodiments, the length of the prepared peptidomimetic macrocycle is 20. In some embodiments, the length of the prepared peptidomimetic macrocycle is 21.

A peptidomimetic macrocycle with enhanced cell penetrability can be prepared based on the von Heijne value of the polypeptide. In some embodiments, the von Heijne value of the prepared peptidomimetic macrocycle ranges from 2 to 9. For example, the von Heijne value of the prepared peptidomimetic macrocycle is 2, 3, 4, 5, 6, 7, 8, or 9, along with all values in between. For example, the von Heijne value of the prepared peptidomimetic macrocycle ranges from 2-8, 2-7, 2-6, 2-5, 2-4, or 2-3. For example, the von Heijne value of the prepared peptidomimetic macrocycle ranges from 3-9, 4-9, 5-9, 6-9, 7-9, or 8-9. In some embodiments, the von Heijne value of the prepared peptidomimetic macrocycle ranges from 3 to 8. For example, the von Heijne value of the prepared peptidomimetic macrocycle ranges from 3-7, 3-6, 3-5, or 3-4. For example, the von Heijne value of the prepared peptidomimetic macrocycle ranges from 4-8, 5-8, 6-8, or 7-9.

In some embodiments, the von Heijne value of the prepared peptidomimetic macrocycle ranges from 4 to 7. For example, the von Heijne value of the prepared peptidomimetic macrocycle ranges from 4-6 or 4-5. For example, the von Heijne value of the prepared peptidomimetic macrocycle ranges from 5-7 or 5-6. In some embodiments, the von Heijne value of the prepared peptidomimetic macrocycle ranges from 4-6. In some embodiments, the von Heijne value of the prepared peptidomimetic macrocycle ranges from 4-5. In some embodiments, the von Heijne value of the prepared peptidomimetic macrocycle ranges from 4.5-5.5, including 4.5, 4.6, 4.7, 4.8, 4.9, 5.0, 5.1, 5.2, 5.3, 5.4, and 5.5 along with all values in between. In some embodiments, the von Heijne value of the prepared peptidomimetic macrocycle ranges from 4.5-9.5. For example, the von Heijne value of the prepared peptidomimetic macrocycle ranges from 4.5-8.5, 4.5-7.5, 4.5-6.5, 5.5-9.5, 5.5-8.5, 5.5-7.5, 5.5-6.5, 6.5-9.5, 6.5-8.5, 6.5-7.5, 7.5-9.5, or 7.5-8.5.

A peptidomimetic macrocycle with enhanced cell penetrability can be prepared based on the net charge carried by a peptide. For example, peptidomimetic macrocycles carrying a high number of negative charges can have poor cell permeability. A peptidomimetic macrocycle carrying a high number of positive charges can have good cell permeability, but can cause undesired cell damage (e.g., cell lysis). A prepared peptidomimetic macrocycle can carry a net charge such that the polypeptide is cell permeable, but not damaging to cells (e.g., does not cause cell lysis). In some embodiments, the net charge of the prepared peptidomimetic macrocycle ranges from −4 to +2, including −4, −3, −2, −1, 0, +1, and +2. In some embodiments, the net charge of the prepared peptidomimetic macrocycle ranges from −3 to +1, including −3, −2, −1, 0 and +1.

In some embodiments, the net charge of the prepared peptidomimetic macrocycle ranges from −2 to 0, including −2, −1, and 0. In some embodiments, the net charge of the prepared peptidomimetic macrocycle is zero or negative. In some embodiments, the net charge of the prepared peptidomimetic macrocycle is not positive. In some embodiments, the net charge of the prepared peptidomimetic macrocycle is zero or is not positive. In some embodiments, the net charge of the prepared peptidomimetic macrocycle is −2. In some embodiments, the net charge of the prepared peptidomimetic macrocycle is −1. In some embodiments, the net charge of the prepared peptidomimetic macrocycle is 0.

A peptidomimetic macrocycle with enhanced cell penetrability can be prepared based on the alanine content of the polypeptide. In some embodiments, the alanine content of the prepared peptidomimetic macrocycle ranges from 15% to 50%. For example, the alanine content of the prepared peptidomimetic macrocycle can be 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, and 50%, along with all values in between. In some embodiments, the alanine content of the prepared peptidomimetic macrocycle ranges from 15% to 45%. In some embodiments, the alanine content of the prepared peptidomimetic macrocycle ranges from 15% to 40%. In some embodiments, the alanine content of the prepared peptidomimetic macrocycle ranges from 15% to 35%. In some embodiments, the alanine content of the prepared peptidomimetic macrocycle ranges from 20% to 50%. In some embodiments, the alanine content of the prepared peptidomimetic macrocycle ranges from 20% to 45%. In some embodiments, the alanine content of the prepared peptidomimetic macrocycle ranges from 20% to 40%. In some embodiments, the alanine content of the prepared peptidomimetic macrocycle ranges from 20% to 35%. In some embodiments, the alanine content of the prepared peptidomimetic macrocycle ranges from 20% to 30%. In some embodiments, the alanine content of the prepared peptidomimetic macrocycle ranges from 20% to 25%. In some embodiments, the alanine content of the prepared peptidomimetic macrocycle ranges from 25% to 50%. In some embodiments, the alanine content of the prepared peptidomimetic macrocycle ranges from 25% to 45%. In some embodiments, the alanine content of the prepared peptidomimetic macrocycle ranges from 25% to 40%. For example, the alanine content of the prepared peptidomimetic macrocycle can be 25%, 26%, 27%, 28%, 29%, 30%, 31%, 32%, 33%, 34%, 35%, 36%, 37%, 38%, 39%, and 40% along with all values in between. In some embodiments, the alanine content of the prepared peptidomimetic macrocycle ranges from 25% to 35%. In some embodiments, the alanine content of the prepared peptidomimetic macrocycle ranges from 25% to 30%. In some embodiments, the alanine content of the prepared peptidomimetic macrocycle ranges from 30% to 50%. In some embodiments, the alanine content of the prepared peptidomimetic macrocycle ranges from 30% to 45%. In some embodiments, the alanine content of the prepared peptidomimetic macrocycle ranges from 30% to 40%. In some embodiments, the alanine content of the prepared peptidomimetic macrocycle ranges from 30% to 35%. In some embodiments, the alanine content of the prepared peptidomimetic macrocycle ranges from 35% to 50%. In some embodiments, the alanine content of the prepared peptidomimetic macrocycle ranges from 35% to 45%. In some embodiments, the alanine content of the prepared peptidomimetic macrocycle ranges from 35% to 40%.

A peptidomimetic macrocycle with enhanced cell penetrability can be prepared based on the length and the von Heijne value of the polypeptide. For example, the length of the prepared peptidomimetic macrocycle ranges from 10 amino acids to 24 amino acids, from 11 amino acids to 23 amino acids, from 12 amino acids to 22 amino acids, from 13 amino acids to 21 amino acids, from 14 amino acids to 20 amino acids, from 15 amino acids to 19 amino acids, or from 16 amino acids to 18 amino acids, and the von Heijne value of the prepared peptidomimetic macrocycle ranges from 2 to 9, from 3 to 8, from 4 to 7, from 4 to 6, or from 4 to 5. For example, the length of the prepared peptidomimetic macrocycle is 10 amino acids, 11 amino acids, 12 amino acids, 13 amino acids, 14 amino acids, 15 amino acids, 16 amino acids, 17 amino acids, 18 amino acids, 19 amino acids, 20 amino acids, or 21 amino acids, and the von Heijne value of the prepared peptidomimetic macrocycle ranges from 4.5 to 5.5. For example, the prepared peptidomimetic macrocycle has a length ranging from 14 amino acids to 20 amino acids, and a von Heijne value ranging from 4 and 7.

A peptidomimetic macrocycle with enhanced cell penetrability can be prepared based on the length and the alanine content of the polypeptide. For example, the length of the prepared peptidomimetic macrocycle ranges from 10 amino acids to 24 amino acids, from 11 amino acids to 23 amino acids, from 12 amino acids to 22 amino acids, from 13 amino acids to 21 amino acids, from 14 amino acids to 20 amino acids, from 15 amino acids to 19 amino acids, or from 16 amino acids to 18 amino acids, and the alanine content of the prepared peptidomimetic macrocycle ranges from 15% to 50%, including 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, and 50% along with all values in between. For example, the length of the prepared peptidomimetic macrocycle is 10 amino acids, 11 amino acids, 12 amino acids, 13 amino acids, 14 amino acids, 15 amino acids, 16 amino acids, 17 amino acids, 18 amino acids, 19 amino acids, 20 amino acids, or 21 amino acids, and the alanine content of the prepared peptidomimetic macrocycle ranges from 25% to 40%, including 25%, 26%, 27%, 28%, 29%, 30%, 31%, 32%, 33%, 34%, 35%, 36%, 37%, 38%, 39%, and 40% along with all values in between. For example, the prepared peptidomimetic macrocycle has a length ranging from 14 amino acids to 20 amino acids, and an alanine content ranging from 25% to 40%.

A peptidomimetic macrocycle with enhanced cell penetrability can be prepared based on the length and the net charge of the polypeptide. For example, the length of the prepared peptidomimetic macrocycle ranges from 10 amino acids to 24 amino acids, from 11 amino acids to 23 amino acids, from 12 amino acids to 22 amino acids, from 13 amino acids to 21 amino acids, from 14 amino acids to 20 amino acids, from 15 amino acids to 19 amino acids, or from 16 amino acids to 18 amino acids, and the net charge of the prepared peptidomimetic macrocycle ranges from −3 to 1, including −3, −2, −1, 0 and 1. For example, the length of the prepared peptidomimetic macrocycle is 10 amino acids, 11 amino acids, 12 amino acids, 13 amino acids, 14 amino acids, 15 amino acids, 16 amino acids, 17 amino acids, 18 amino acids, 19 amino acids, 20 amino acids, or 21 amino acids, and the net charge of the prepared peptidomimetic macrocycle ranges from −3 to 1, including −3, −2, −1, 0 and 1. For example, the prepared peptidomimetic macrocycle has a length ranging from 14 amino acids to 20 amino acids, and a net charge ranging from −2 to 0.

A peptidomimetic macrocycle with enhanced cell penetrability can be prepared based on the von Heijne value and the net charge of the polypeptide. For example, the von Heijne value of the prepared peptidomimetic macrocycle ranges from 2 to 9, from 3 to 8, from 4 to 7, from 4 to 6, or from 4 to 5, and the net charge of the prepared peptidomimetic macrocycle ranges from −3 to 1, including −3, −2, −1, 0 and 1. For example, the von Heijne value of the prepared peptidomimetic macrocycle ranges from 4.5 to 5.5, including 4.5, 4.6, 4.7, 4.8, 4.9, 5.0, 5.1, 5.2, 5.3, 5.4, and 5.5 along with all values in between, and the net charge of the prepared peptidomimetic macrocycle ranges from −3 to 1, including −3, −2, −1, 0 and 1. For example, the prepared peptidomimetic macrocycle has a von Heijne value ranging from 4 and 7, and a net charge ranging from −2 to 0.

A peptidomimetic macrocycle with enhanced cell penetrability can be prepared based on the von Heijne value and the alanine content of the polypeptide. For example, the von Heijne value of the prepared peptidomimetic macrocycle ranges from 2 to 9, from 3 to 8, from 4 to 7, from 4 to 6, or from 4 to 5, and the alanine content of the prepared peptidomimetic macrocycle ranges from 15% to 50%, including 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, and 50% along with all values in between. For example, the von Heijne value of the prepared peptidomimetic macrocycle ranges from 4.5 to 5.5, including 4.5, 4.6, 4.7, 4.8, 4.9, 5.0, 5.1, 5.2, 5.3, 5.4, and 5.5 along with all values in between, and the alanine content of the prepared peptidomimetic macrocycle ranges from 25% to 40%, including 25%, 26%, 27%, 28%, 29%, 30%, 31%, 32%, 33%, 34%, 35%, 36%, 37%, 38%, 39%, and 40% along with all values in between. For example, the prepared peptidomimetic macrocycle has a von Heijne value ranging from 4 and 7, and an alanine content ranging from 25% to 40%.

A peptidomimetic macrocycle with enhanced cell penetrability can be prepared based on length, von Heijne value and alanine content of the polypeptide. For example, the prepared peptidomimetic macrocycle has a length ranging from 14 amino acids to 20 amino acids, a von Heijne value ranging from 4 and 7, and an alanine content ranging from 25% to 40%.

A peptidomimetic macrocycle with enhanced cell penetrability can be prepared based on the von Heijne value and the net charge of the polypeptide. For example, the prepared peptidomimetic macrocycle has a length ranging from 14 amino acids to 20 amino acids, a von Heijne value ranging from 4 and 7, and a net charge ranging from −2 to 0.

A peptidomimetic macrocycle with enhanced cell penetrability can be prepared based on the von Heijne value, the net charge, and the alanine content of the polypeptide. For example, the prepared peptidomimetic macrocycle has a von Heijne value ranging from 4 and 7, a net charge ranging from −2 to 0, and an alanine content ranging from 25% to 40%.

A peptidomimetic macrocycle with enhanced cell penetrability can be prepared based on the length, the net charge, and the alanine content of the polypeptide. For example, the prepared peptidomimetic macrocycle has a length ranging from 14 amino acids to 20 amino acids, a net charge ranging from −2 to 0, and an alanine content ranging from 25% to 40%.

A peptidomimetic macrocycle with enhanced cell penetrability can be prepared based on the length of its amino acid sequence, its von Heijne value, its net charge, and the alanine content of its amino acid sequence. For example, the prepared peptidomimetic macrocycle has a length ranging from 14 amino acids to 20 amino acids, a von Heijne value ranging from 4 and 7, a net charge ranging from −2 to 0, and an alanine content ranging from 25% to 40%.

In some embodiments, a peptidomimetic macrocycle with enhanced cell penetrability can be prepared based on the reverse-phase HPLC retention time of the polypeptide.

In some embodiments, a peptidomimetic macrocycle with enhanced cell penetrability can be prepared based on amphipathicity of the polypeptide.

In some embodiments, a peptidomimetic macrocycle with enhanced cell penetrability can be prepared based on solubility of the polypeptide, for example if the prepared peptidomimetic macrocycle is determined to be soluble based on visual examination of the turbidity of a solution of the polypeptide.

Assay to Determine α-Helicity

In solution, the secondary structure of polypeptides with α-helical domains will reach a dynamic equilibrium between random coil structures and α-helical structures, often expressed as a "percent helicity". Thus, for example, alpha-helical domains are predominantly random coils in solution, with α-helical content usually under 25%. Peptidomimetic macrocycles with optimized linkers, on the other hand, possess, for example, an alpha-helicity that is at least two-fold greater than that of a corresponding uncrosslinked polypeptide. In some embodiments, macrocycles will possess an alpha-helicity of greater than 50%. To assay the helicity of peptidomimetic macrocycles, the compounds are dissolved in an aqueous solution (e.g. 50 mM potassium phosphate solution at pH 7, or distilled $H_2O$, to concentrations of 25-50 µM). Circular dichroism (CD) spectra are obtained on a spectropolarimeter (e.g., Jasco J-710) using standard measurement parameters (e.g. temperature, 20° C.; wavelength, 190-260 nm; step resolution, 0.5 nm; speed, 20 nm/sec; accumulations, 10; response, 1 sec; bandwidth, 1 nm; path length, 0.1 cm). The α-helical content of each peptide is calculated by dividing the mean residue ellipticity (e.g. [Φ]222 obs) by the reported value for a model helical decapeptide (Yang et al. (1986), *Methods Enzymol*. 130: 208)).

Assay to Determine Melting Temperature (Tm)

A peptidomimetic macrocycle comprising a secondary structure such as an α-helix exhibits, for example, a higher melting temperature than a corresponding uncrosslinked polypeptide. Typically peptidomimetic macrocycles exhibit Tm of >60° C. representing a highly stable structure in aqueous solutions. To assay the effect of macrocycle formation on melting temperature, peptidomimetic macrocycles or unmodified peptides are dissolved in distilled $H_2O$ (e.g. at a final concentration of 50 µM) and the Tm is determined by measuring the change in ellipticity over a temperature range (e.g. 4 to 95° C.) on a spectropolarimeter (e.g., Jasco J-710) using standard parameters (e.g. wavelength 222 nm; step resolution, 0.5 nm; speed, 20 nm/sec; accumulations, 10; response, 1 sec; bandwidth, 1 nm; temperature increase rate: 1° C./min; path length, 0.1 cm).

Protease Resistance Assay

The amide bond of the peptide backbone is susceptible to hydrolysis by proteases, thereby rendering peptidic compounds vulnerable to rapid degradation in vivo. Peptide helix formation, however, typically buries the amide backbone and therefore can shield it from proteolytic cleavage. The peptidomimetic macrocycles can be subjected to in vitro trypsin proteolysis to assess for any change in degradation rate compared to a corresponding uncrosslinked polypeptide. For example, the peptidomimetic macrocycle and a corresponding uncrosslinked polypeptide are incubated with trypsin agarose and the reactions quenched at various time points by centrifugation and subsequent HPLC injection to quantitate the residual substrate by ultraviolet absorption at 280 nm. Briefly, the peptidomimetic macrocycle and peptidomimetic precursor (5 mcg) are incubated with trypsin agarose (Pierce) (S/E~125) for 0, 10, 20, 90, and 180 minutes. Reactions are quenched by tabletop centrifugation at high speed; remaining substrate in the isolated supernatant is quantified by HPLC-based peak detection at 280 nm. The proteolytic reaction displays first order kinetics and the rate constant, k, is determined from a plot of ln[S] versus time (k=−1λslope).

Ex Vivo Stability Assay

Peptidomimetic macrocycles with optimized linkers possess, for example, an ex vivo half-life that is at least two-fold greater than that of a corresponding uncrosslinked polypeptide, and possess an ex vivo half-life of 12 hours or more. For ex vivo serum stability studies, a variety of assays can be used. For example, a peptidomimetic macrocycle and a corresponding uncrosslinked polypeptide (2 mcg) are incubated with fresh mouse, rat and/or human serum (2 mL) at 37° C. for 0, 1, 2, 4, 8, and 24 hours. To determine the level of intact compound, the following procedure can be used: The samples are extracted by transferring 100 µl of sera to 2 ml centrifuge tubes followed by the addition of 10 µL of 50% formic acid and 5004 acetonitrile and centrifugation at 14,000 RPM for 10 mM at 4±2° C. The supernatants are then transferred to fresh 2 ml tubes and evaporated on Turbovap under $N_2$<10 psi, 37° C. The samples are reconstituted in 1004 of 50:50 acetonitrile:water and submitted to LC-MS/MS analysis.

In Vitro Binding Assays

To assess the binding and affinity of peptidomimetic macrocycles and peptidomimetic precursors to acceptor proteins, a fluorescence polarization assay (FPA) is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution).

For example, fluoresceinated peptidomimetic macrocycles (25 nM) are incubated with the acceptor protein (25-1000 nM) in binding buffer (140 mM NaCl, 50 mM Tris-HCL, pH 7.4) for 30 minutes at room temperature. Binding activity is measured, for example, by fluorescence polarization on a luminescence spectrophotometer (e.g. Perkin-Elmer LS50B). Kd values can be determined by non-linear regression analysis using, for example, Graphpad Prism software (GraphPad Software, Inc., San Diego, Calif.). A peptidomimetic macrocycle shows, In some embodiments, similar or lower Kd than a corresponding uncrosslinked polypeptide.

In Vitro Displacement Assays to Characterize Antagonists of Peptide-Protein Interactions To assess the binding and affinity of compounds that antagonize the interaction between a peptide and an acceptor protein, a fluorescence polarization assay (FPA) utilizing a fluoresceinated peptidomimetic macrocycle derived from a peptidomimetic precursor sequence is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution). A compound that antagonizes the interaction between the fluoresceinated peptidomimetic macrocycle and an acceptor protein will be detected in a competitive binding FPA experiment.

For example, putative antagonist compounds (1 nM to 1 mM) and a fluoresceinated peptidomimetic macrocycle (25 nM) are incubated with the acceptor protein (50 nM) in binding buffer (140 mM NaCl, 50 mM Tris-HCL, pH 7.4) for 30 minutes at room temperature. Antagonist binding activity is measured, for example, by fluorescence polarization on a luminescence spectrophotometer (e.g. Perkin-Elmer LS50B). Kd values can be determined by nonlinear regression analysis using, for example, Graphpad Prism software (GraphPad Software, Inc., San Diego, Calif.).

Any class of molecule, such as small organic molecules, peptides, oligonucleotides or proteins can be examined as putative antagonists in this assay.

Assay for Protein-ligand binding by Affinity Selection-Mass Spectrometry

To assess the binding and affinity of test compounds for proteins, an affinity-selection mass spectrometry assay is used, for example. Protein-ligand binding experiments are conducted according to the following representative procedure outlined for a system-wide control experiment using 1

µM peptidomimetic macrocycle plus 5 µM hMDM2. A 1 µL DMSO aliquot of a 40 µM stock solution of peptidomimetic macrocycle is dissolved in 19 µL of PBS (Phosphate-buffered saline: 50 mM, pH 7.5 Phosphate buffer containing 150 mM NaCl). The resulting solution is mixed by repeated pipetting and clarified by centrifugation at 10 000 g for 10 min. To a 4 µL aliquot of the resulting supernatant is added 4 µL of 10 µM hMDM2 in PBS. Each 8.0 µL experimental sample thus contains 40 pmol (1.5 µg) of protein at 5.0 µM concentration in PBS plus 1 µM peptidomimetic macrocycle and 2.5% DMSO. Duplicate samples thus prepared for each concentration point are incubated for 60 min at room temperature, and then chilled to 4° C. prior to size-exclusion chromatography-LC-MS analysis of 5.0 µL injections. Samples containing a target protein, protein-ligand complexes, and unbound compounds are injected onto an SEC column, where the complexes are separated from non-binding component by a rapid SEC step. The SEC column eluate is monitored using UV detectors to confirm that the early-eluting protein fraction, which elutes in the void volume of the SEC column, is well resolved from unbound components that are retained on the column. After the peak containing the protein and protein-ligand complexes elutes from the primary UV detector, it enters a sample loop where it is excised from the flow stream of the SEC stage and transferred directly to the LC-MS via a valving mechanism. The $(M+3H)^{3+}$ ion of the peptidomimetic macrocycle is observed by ESI-MS at the expected m/z, confirming the detection of the protein-ligand complex.

Assay for Protein-ligand Kd Titration Experiments

To assess the binding and affinity of test compounds for proteins, a protein-ligand Kd titration experiment is performed, for example. Protein-ligand $K_d$ titrations experiments are conducted as follows: 2 µL DMSO aliquots of a serially diluted stock solution of titrant peptidomimetic macrocycle (5, 2.5, . . . , 0.098 mM)$_a$re prepared then dissolved in 38 µl of PBS. The resulting solutions are mixed by repeated pipetting and clarified by centrifugation at 10 000 g for 10 min. To 4.0 µL aliquots of the resulting supernatants is added 4.0 µL of 10 µM hMDM2 in PBS. Each 8.0 µL experimental sample thus contains 40 pmol (1.5 µg) of protein at 5.0 µM concentration in PBS, varying concentrations (125, 62.5, . . . , 0.24 µM) of the titrant peptide, and 2.5% DMSO. Duplicate samples thus prepared for each concentration point are incubated at room temperature for 30 min, then chilled to 4° C. prior to SEC-LC-MS analysis of 2.0 µL injections. The $(M+H)^{1+}$, $(M+2H)^{2-}$, $(M+3H)^{3+}$, and/or $(M+Na)^{1+}$ ion is observed by ESI-MS; extracted ion chromatograms are quantified, then fit to equations to derive the binding affinity $K_d$ as described in "A General Technique to Rank Protein-Ligand Binding Affinities and Determine Allosteric vs. Direct Binding Site Competition in Compound Mixtures." Annis, D. A.; Nazef, N.; Chuang, C. C.; Scott, M. P.; Nash, H. M. *J. Am. Chem. Soc.* 2004, 126, 15495-15503: also in "*ALIS: An Affinity Selection-Mass Spectrometry System for the Discovery and Characterization of Protein-Ligand Interactions*" D. A. Annis, C.-C. Chuang, and N. Nazef. In Mass Spectrometry in Medicinal Chemistry. Edited by Wanner K, Höfner G: Wiley-VCH; 2007:121-184. Mannhold R, Kubinyi H, Folkers G (Series Editors): Methods and Principles in Medicinal Chemistry.

Assay for Competitive Binding Experiments by Affinity Selection-Mass Spectrometry To determine the ability of test compounds to bind competitively to proteins, an affinity selection mass spectrometry assay is performed, for example. A mixture of ligands at 40 µM per component is prepared by combining 2 µL aliquots of 400 µM stocks of each of the three compounds with 14 µL of DMSO. Then, 1 µL aliquots of this 40 µM per component mixture are combined with 1 µL DMSO aliquots of a serially diluted stock solution of titrant peptidomimetic macrocycle (10, 5, 2.5, . . . , 0.078 mM). These 2 µL samples are dissolved in 38 µL of PBS. The resulting solutions were mixed by repeated pipetting and clarified by centrifugation at 10 000 g for 10 min. To 4.0 µL aliquots of the resulting supernatants is added 4.0 µL of 10 µM hMDM2 protein in PBS. Each 8.0 µL experimental sample thus contains 40 pmol (1.5 µg) of protein at 5.0 µM concentration in PBS plus 0.5 µM ligand, 2.5% DMSO, and varying concentrations (125, 62.5, . . . , 0.98 µM) of the titrant peptidomimetic macrocycle. Duplicate samples thus prepared for each concentration point are incubated at room temperature for 60 min, then chilled to 4° C. prior to SEC-LC-MS analysis of 2.0 µL injections. Additional details on these and other methods are provided in "*A General Technique to Rank Protein-Ligand Binding Affinities and Determine Allosteric vs. Direct Binding Site Competition in Compound Mixtures.*" Annis, D. A.; Nazef, N.; Chuang, C. C.; Scott, M. P.; Nash, H. M. J. Am. Chem. Soc. 2004, 126, 15495-15503; also in "*ALIS: An Affinity Selection-Mass Spectrometry System for the Discovery and Characterization of Protein-Ligand Interactions*" D. A. Annis, C.-C. Chuang, and N. Nazef. In Mass Spectrometry in Medicinal Chemistry. Edited by Wanner K, Höfner G: Wiley-VCH; 2007:121-184. Mannhold R, Kubinyi H, Folkers G (Series Editors): Methods and Principles in Medicinal Chemistry.

Binding Assays in Intact Cells

It is possible to measure binding of peptides or peptidomimetic macrocycles to their natural acceptors in intact cells by immunoprecipitation experiments. For example, intact cells are incubated with fluoresceinated (FITC-labeled) compounds for 4 hrs in the absence of serum, followed by serum replacement and further incubation that ranges from 4-18 hrs. Cells are then pelleted and incubated in lysis buffer (50 mM Tris [pH 7.6], 150 mM NaCl, 1% CHAPS and protease inhibitor cocktail) for 10 minutes at 4° C. Extracts are centrifuged at 14,000 rpm for 15 minutes and supernatants collected and incubated with 10 µl goat anti-FITC antibody for 2 hrs, rotating at 4° C. followed by further 2 hrs incubation at 4° C. with protein A/G Sepharose (50 µl of 50% bead slurry). After quick centrifugation, the pellets are washed in lysis buffer containing increasing salt concentration (e.g., 150, 300, 500 mM). The beads are then re-equilibrated at 150 mM NaCl before addition of SDS-containing sample buffer and boiling. After centrifugation, the supernatants are optionally electrophoresed using 4%-12% gradient Bis-Tris gels followed by transfer into Immobilon-P membranes. After blocking, blots are optionally incubated with an antibody that detects FITC and also with one or more antibodies that detect proteins that bind to the peptidomimetic macrocycle.

Cellular Penetrability Assays

A peptidomimetic macrocycle is, for example, more cell penetrable compared to a corresponding uncrosslinked macrocycle. Peptidomimetic macrocycles with optimized linkers possess, for example, cell penetrability that is at least two-fold greater than a corresponding uncrosslinked macrocycle, and often 20% or more of the applied peptidomimetic macrocycle will be observed to have penetrated the cell after 4 hours. To measure the cell penetrability of peptidomimetic macrocycles and corresponding uncrosslinked macrocycle, intact cells are incubated with fluorescently-labeled (e.g. fluoresceinated) peptidomimetic macrocycles or corresponding uncrosslinked macrocycle (10 µM) for 4 hrs in serum free media at 37° C., washed twice with media and incubated with trypsin (0.25%) for 10 min at 37° C. The cells are washed again and resuspended in PBS. Cellular fluorescence is analyzed, for example, by using either a FACSCalibur flow cytometer or Cellomics' KineticScan® HCS Reader.

Cellular Efficacy Assays

The efficacy of certain peptidomimetic macrocycles is determined, for example, in cell-based killing assays using a variety of tumorigenic and non-tumorigenic cell lines and primary cells derived from human or mouse cell populations. Cell viability is monitored, for example, over 24-96 hrs of incubation with peptidomimetic macrocycles (0.5 to 50 µM) to identify those that kill at $EC_{50}<10$ µM. Several standard assays that measure cell viability are commercially available and are optionally used to assess the efficacy of the peptidomimetic macrocycles. In addition, assays that measure Annexin V and caspase activation are optionally used to assess whether the peptidomimetic macrocycles kill cells by activating the apoptotic machinery. For example, the Cell Titer-glo assay is used which determines cell viability as a function of intracellular ATP concentration.

In Vivo Stability Assay

To investigate the in vivo stability of the peptidomimetic macrocycles, the compounds are, for example, administered to mice and/or rats by IV, IP, PO or inhalation routes at concentrations ranging from 0.1 to 50 mg/kg and blood specimens withdrawn at 0', 5', 15', 30', 1 hr, 4 hrs, 8 hrs and 24 hours post-injection. Levels of intact compound in 25 µL of fresh serum are then measured by LC-MS/MS as above.

In vivo Efficacy in Animal Models

To determine the anti-oncogenic activity of peptidomimetic macrocycles in vivo, the compounds are, for example, given alone (IP, IV, PO, by inhalation or nasal routes) or in combination with sub-optimal doses of relevant chemotherapy (e.g., cyclophosphamide, doxorubicin, etoposide). In one example, $5 \times 10^6$ RS4; 11 cells (established from the bone marrow of a patient with acute lymphoblastic leukemia) that stably express luciferase are injected by tail vein in NOD-SCID mice 3 hrs after they have been subjected to total body irradiation. If left untreated, this form of leukemia is fatal in 3 weeks in this model. The leukemia is readily monitored, for example, by injecting the mice with D-luciferin (60 mg/kg) and imaging the anesthetized animals (e.g., Xenogen In Vivo Imaging System, Caliper Life Sciences, Hopkinton, Mass.). Total body bioluminescence is quantified by integration of photonic flux (photons/sec) by Living Image Software (Caliper Life Sciences, Hopkinton, Mass.). Peptidomimetic macrocycles alone or in combination with sub-optimal doses of relevant chemotherapeutics agents are, for example, administered to leukemic mice (10 days after injection/day 1 of experiment, in bioluminescence range of 14-16) by tail vein or IP routes at doses ranging from 0.1 mg/kg to 50 mg/kg for 7 to 21 days. Optionally, the mice are imaged throughout the experiment every other day and survival monitored daily for the duration of the experiment. Expired mice are optionally subjected to necropsy at the end of the experiment. Another animal model is implantation into NOD-SCID mice of DoHH2, a cell line derived from human follicular lymphoma, that stably expresses luciferase. These in vivo tests optionally generate preliminary pharmacokinetic, pharmacodynamic and toxicology data.

Clinical Trials

To determine the suitability of the peptidomimetic macrocycles for treatment of humans, clinical trials are performed. For example, patients diagnosed with solid tumor and in need of treatment can be selected and separated in treatment and one or more control groups, wherein the treatment group is administered a peptidomimetic macrocycle, while the control groups receive a placebo or a known anti-cancer drug. The treatment safety and efficacy of the peptidomimetic macrocycles can thus be evaluated by performing comparisons of the patient groups with respect to factors such as survival and quality-of-life. In this example, the patient group treated with a peptidomimetic macrocycle can show improved long-term survival compared to a patient control group treated with a placebo.

Chemical Stability

To assay the chemical stability of the aqueous pharmaceutical formulations disclosed herein, 1 mL of the aqueous pharmaceutical formulation is filled in 2-mL vials with 13-mm Ø stoppers. The smaller vial size can help provide a greater surface-to-volume ratio which would amplify any container/closure effects on product stability. To assure that all surfaces of the vials were challenged, the vials can be stored in an inverted position. The vials are stored at the desired assay temperature, for example −20° C., 5° C., 20° C., and 40° C. for the desired assay time. For example for 1, 2, 3 or 6 months. The samples are analyzed by reverse phase HPLC. Tables 8-12 and 14-17 depict the results of this study. The samples can also be analyzed for particulate matter.

In vitro Testing for Inhibition of Influenza Replication

This influenza antiviral evaluation assay examines the effects of compounds at designated dose-response concentrations. See also Noah, J. W., W. Severson, D. L. Noah, L. Rasmussen, E. L. White, and C. B. Jonsson, Antiviral Res, 2007. 73(1): p. 50-9. Madin Darby canine kidney (MDCK) cells are used in the assay to test the efficacy of the compounds in preventing the cytopathic effect (CPE) induced by influenza infection. Either Ribavirin or Tamiflu is included in each run as a positive control compound. Subconfluent cultures of MDCK cells are plated into 96-well plates for the analysis of cell viability (cytotoxicity) and antiviral activity (CPE). Drugs are added to the cells 24 hr later. At a designated time, the CPE wells also receive 100 tissue culture infectious doses (100 TCID50s) of titered influenza virus. 72 hr later the cell viability is determined. The effective compound concentrations which reduce viral-induced CPE by 25% (IC25), 50% (IC50), and 90% (IC90) are calculated by regression analysis with semi-log curve fitting. Cell viability is assessed using CellTiter-Glo (Promega). The toxic concentration of drug that reduces cell numbers by 50% and 90% (TC50 and TC90, respectively) are calculated as well. Selectivity (therapeutic) indices (SI=TC/IC) are also calculated.

In vivo Testing for Inhibition of Influenza Replication

In vivo testing of compounds can be performed, including testing on mammals such as rats or ferrets. Because ferrets (*Mustela* putorius furo) are naturally susceptible to infection with human influenza A and B viruses and their disease resembles that of human influenza, these animals have been widely used as a model for influenza virus pathogenesis and immunity studies. See Sidwell, R. W. and D. F. Smee, Antiviral Res, 2000. 48(1): p. 1-16; and Colacino, J. M., D. C. DeLong, J. R. Nelson, W. A. Spitzer, J. Tang, F. Victor, and C. Y. Wu, Antimicrob Agents Chemother, 1990. 34(11): p. 2156-63. Ferrets are also the model of choice for the study of avian influenza virus H5N1 pathogenesis in mammals. See also Zitzow, L. A., T. Rowe, T. Morken, W.-J. Shieh, S. Zaki, and J. M. Katz, Pathogenesis of Avian Influenza A (H5N1) Viruses in Ferrets. 2002. p. 4420-4429. The activities of the PB1 Stapled Peptides can be compared to Ribavirin or Oseltamivir as a positive control.

Briefly, young adult male or female ferrets (five ferrets for each treatment group) that are serologically negative by hemagglutination inhibition assay for currently circulating human influenza A or B viruses are quarantined at least 4 days prior to infection in a BSL-3+ animal holding area, where they are housed in cages contained in bioclean portable laminar flow clean room enclosures (Lab Products, Seaford, Del.). Prior to infection, baseline temperatures are measured twice daily for at least 3 days. Ferrets are anesthetized with ketamine (25 mg/kg), xylazine (2 mg/kg), and atropine (0.05 mg/kg) by the intramuscular route and infected intranasally (i.n.) with virus/mL in phosphate-buffered saline (PBS) delivered to the nostrils. Control animals are mock-infected with an equivalent dilution (1:30) of noninfectious allantoic fluid. Stapled Peptides are administered i.v. or i.p. one hour after virus infection. Temperatures are measured twice daily using either a rectal thermometer or a subcutaneous implantable temperature transponder (BioMedic Data Systems, Inc., Seaford, Del.) with pre-infection values averaged to obtain a baseline temperature for each ferret. The change in temperature (in degrees Celsius) is calculated at each time point for each animal. Clinical signs of sneezing (before anesthesia), inappetence, dyspnea, and level of activity are assessed. A scoring system is also used to assess the activity level, and based on the daily scores for each animal in a group a relative inactivity index will be calculated. Rectal temperature and activity scores are used to assess the severity of influenza infection and the ability of Stapled Peptides to prevent flu symptoms Assaying Inhibition of Viral Polymerase Complex Assembly and Activity The technique of Bimolecular Fluorescence Complementation ("BiFC") can be used to assay the compounds. In this technique, N- and C-terminal fragments of fluorescent proteins (e.g. GFP or its derivatives) are fused to interacting proteins. The two non-functional halves of the fluorophore, following the expression in cells, are brought into close proximity as a result of the specific protein interactions, which initiates folding of the fragments into an active protein and results in a detectable fluorescent signal at the site of the protein-protein complex. Thus, through BiFC, the specific interaction between PB1 and PA subunits can be visualized, quantified and localized within live cells. By disrupting PB1-PA interaction with a compound, the BiFC signal will be reduced, indicative of the presence of potential inhibitors targeting the assembly of PB1-PA complex. See Hemerka et. al., J. Virol. 2009, 3944-3955.

Manufacturing of the Aqueous Pharmaceutical Formulation

In another aspect of the disclosure relates to a method of making the aqueous pharmaceutical formulations disclosed herein. The method comprising the steps of dissolving at least one peptidomimetic macrocycle, or a pharmaceutically acceptable salt thereof in an aqueous solution. The method can further comprise of stirring the peptide mixture for some additional time. For example, the peptide mixture can be allowed to be stirred for an additional period of 1 min, 2 min, 3 min, 4 min, 5 min, 6 min, 7 min, 8 min, 9 min, 10 min, 15 min, 30 min, 45 min, 1 h, 1.5 h, 2 h or more.

In some embodiments, the peptidomimetic macrocycle is added to the aqueous solution at once. In some embodiments, the peptidomimetic macrocycle is added slowly to the aqueous solution, for example over a period of at least about 1 min, 2 min, 3 min, 4 min, 5 min, 6 min, 7 min, 8 min, 9 min, 10 min, 15 min, 30 min, 45 min, 1 h, 1.5 h, 2 h or more. In some embodiments, the peptidomimetic macrocycle is added slowly over a period of at most about 2 h, 1.5 h, 1 h, 45 min, 30 min, 15 min, 10 min, 9 min, 8 min, 7 min, 6 min, 5 min, 4 min, 3 min, 2 min, 1 min or less.

The aqueous solution comprises an aqueous diluent. The amount of the aqueous diluent can be in the range of about 10-99% w/v of formulation. In some embodiments, the amount of aqueous diluent in the formulation is about 50-99% w/v. For example, the amount of aqueous diluent is in the range of about 50-95% w/v, about 50-90% w/v, about 50-85% w/v, about 50-80% w/v, about 50-75% w/v, about 50-70% w/v, about 50-65% w/v, about 50-60% w/v, about 50-55% w/v, about 55-95% w/v, about 55-90% w/v, about 55-85% w/v, about 55-80% w/v, about 55-75% w/v, about 55-70% w/v, about 55-65% w/v, about 55-60% w/v, about 60-95% w/v, about 60-90% w/v, about 60-85% w/v, about 60-80% w/v, about 60-75% w/v, about 60-70% w/v, about 60-65% w/v, about 65-95% w/v, about 65-90% w/v, about 65-85% w/v, about 65-80% w/v, about 65-75% w/v, about 65-70% w/v, about 70-95% w/v, about 70-90% w/v, about 70-85% w/v, 70-80% w/v, about 70-75% w/v, about 75-95% w/v, about 75-90% w/v, about 75-85% w/v, about 75-80% w/v, about 70-95% w/v, about 70-90% w/v, about 70-85% w/v, about 70-80% w/v, about 70-75% w/v, about 75-95% w/v, about 75-90% w/v, about 75-85% w/v, about 75-80% w/v, about 80-95% w/v, about 80-90% w/v, about 80-85% w/v, about 85-95% w/v, about 85-90% w/v, or about 90-95% w/v. In some embodiments, the amount of aqueous diluent in a formulation is about 85-99% w/v. In some embodiments, the amount of the aqueous diluent in a formulation is about 85% w/v, about 86% w/v, about 87% w/v, about 88% w/v, about 89% w/v, about 90% w/v, about 91% w/v, about 92% w/v, about 93% w/v, about 94% w/v, about 95% w/v, about 96% w/v, about 97% w/v, about 98% w/v, or about 99% w/v. In some embodiments, the amount of the aqueous diluent in the formulation is about 90% w/v. In some embodiments, the amount of the diluent in the formulation is about 10% w/v, about 20% w/v, about 30% w/v, about 40% w/v, about 50% w/v, about 60% w/v, about 70% w/v, about 80% w/v, or about 90% w/v. In some embodiments the diluent is water (for example, water for injection) and it comprises about 90% w/v of the formulation.

The amount of a peptidomimetic macrocycle in the aqueous pharmaceutical formulations disclosed herein can range from about 0.0001-50.0% w/v. For example, the amount of the a peptidomimetic macrocycle can be about 0.0001-10.0 w/v %, about 0.005-10.0% w/v, about 0.01-10.0% w/v, about 0.05-10.0% w/v, about 0.1-10.0% w/v, about 0.5-10.0% w/v, about 1.0-10.0% w/v, about 2.0-10.0% w/v, about 3.0-10.0% w/v, about 4.0-10.0% w/v, about 5.0-10.0% w/v, 6.0-10.0% w/v, about 7.0-10.0% w/v, about 8.0-10.0% w/v, about 9.0-10.0% w/v, about 0.0001-5.0 w/v %, about 0.005-5.0% w/v, about 0.01-5.0% w/v, about 0.05-5.0% w/v, about 0.1-5.0% w/v, about 0.5-5.0% w/v, about 1.0-5.0% w/v, about 2.0-5.0% w/v, about 3.0-5.0% w/v, about 4.0-5.0% w/v, about 0.0001-2.0 w/v %, about 0.005-2.0% w/v, about 0.01-2.0% w/v, about 0.05-2.0% w/v, about 0.1-2.0% w/v, about 0.5-2.0% w/v, or about 1.0-2.0% w/v. In some embodiments, the peptidomimetic macrocycle is a p53-based peptidomimetic macrocycle and the amount is about 0.1-5.0% w/v, for example about 1.0% w/v, about 1.5% w/v, or about 2.0% w/v.

In some embodiments, the amount of the peptidomimetic macrocycle is in the range of about 1-20.0% w/v, 5-20.0% w/v, about 7-20.0% w/v, about 10-20.0% w/v, about 12-20.0% w/v, 15-20.0% w/v, 17-20.0% w/v, about 5-25.0% w/v, 7-25.0% w/v, 10-25.0% w/v, 12-25.0% w/v, 15-25.0% w/v, 17-25.0% w/v, 20-25.0% w/v, or 22-25.0% w/v;

5-35.0% w/v, 7-35.0% w/v, 10-35.0% w/v, 12-35.0% w/v, 15-35.0% w/v, 17-35.0% w/v, 20-35.0% w/v, 22-35.0% w/v, 25-35.0% w/v, 27-35.0% w/v, 30-35.0% w/v, or 32-35.0% w/v; 5-40.0% w/v, 7-40.0% w/v, about 10-40.0% w/v, about 12-40.0% w/v, about 15-40.0% w/v, about 17-40.0% w/v, about 20-40.0% w/v, 22-40.0% w/v, 25-40.0% w/v, 27-40.0% w/v, 30-40.0% w/v, 33-40.0% w/v, 35-40.0% w/v, or 37-40.0% w/v; 5-50.0% w/v, 10-50.0% w/v, 12-50.0% w/v, 15-50.0% w/v, 20-50.0% w/v, 22-50.0% w/v, 25-50.0% w/v, 27-50.0% w/v, 30-50.0% w/v, 32-50.0% w/v, 35-50.0% w/v, 37-50.0% w/v, 40-50.0% w/v, 42-50.0% w/v, 45-50.0% w/v, or 47-50.0% w/v.

In some embodiments, the amount of peptidomimetic macrocycle is about 0.5%, about 1.0%, about 1.5%, about 2.0%, about 2.5%, about 3.0%, about 3.5%, about 4.0%, about 4.5%, about 5.0%, about 5.5%, about 6.0%, about 6.5%, about 7.0%, about 7.5%, about 8.0%, about 8.5%, about 9.0%, about 9.5, about 10%, about 15%, about 20%, about 25%, about 30%, about 35%, about 40%, about 45%, or about 50% w/v.

The concentration of a peptidomimetic macrocycle in the aqueous pharmaceutical formulations disclosed herein can be in the range of about 1-100 mg/mL. In some embodiments, the amount of a peptidomimetic macrocycle in the formulation is about 1-5 mg/mL, about 1-10 mg/mL, about 1-15 mg/mL, about 1-20 mg/mL, about 1-25 mg/mL, about 1-30 mg/mL, about 1-35 mg/mL, about 1-40 mg/mL, about 1-45 mg/mL, about 1-50 mg/mL, about 1-60 mg/mL, about 1-70 mg/mL, about 1-80 mg/mL, about 1-90 mg/mL, about 5-10 mg/mL, about 5-15 mg/mL, about 5-20 mg/mL, about 5-25 mg/mL, about 5-30 mg/mL, about 5-35 mg/mL, about 5-40 mg/mL, about 5-45 mg/mL, about 5-50 mg/mL, about 5-60 mg/mL, about 5-70 mg/mL, about 5-80 mg/mL, about 5-90 mg/mL, about 5-100 mg/mL, about 10-15 mg/mL, about 10-20 mg/mL, about 10-25 mg/mL, about 10-30 mg/mL, about 10-35 mg/mL, about 10-40 mg/mL, about 10-45 mg/mL, about 10-50 mg/mL, about 10-60 mg/mL, about 10-70 mg/mL, about 10-80 mg/mL, about 10-90 mg/mL, about 10-100 mg/mL, about 15-20 mg/mL, about 15-25 mg/mL, about 15-30 mg/mL, about 15-35 mg/mL, about 15-40 mg/mL, about 15-45 mg/mL, about 15-50 mg/mL, about 15-60 mg/mL, about 15-70 mg/mL, about 15-80 mg/mL, about 15-90 mg/mL, about 15-100 mg/mL, about 20-25 mg/mL, about 20-30 mg/mL, about 20-35 mg/mL, about 20-40 mg/mL, about 20-45 mg/mL, about 20-50 mg/mL, about 20-60 mg/mL, about 20-70 mg/mL, about 20-80 mg/mL, about 20-90 mg/mL, about 20-100 mg/mL, about 25-30 mg/mL, about 25-35 mg/mL, about 25-40 mg/mL, about 25-45 mg/mL, about 25-50 mg/mL, about 25-60 mg/mL, about 25-70 mg/mL, about 25-80 mg/mL, about 25-90 mg/mL, about 25-100 mg/mL, about 30-35 mg/mL, about 30-40 mg/mL, about 30-45 mg/mL, about 30-50 mg/mL, about 30-60 mg/mL, about 30-70 mg/mL, about 30-80 mg/mL, about 30-90 mg/mL, about 30-100 mg/mL, about 35-40 mg/mL, about 35-45 mg/mL, about 35-50 mg/mL, about 35-60 mg/mL, about 35-70 mg/mL, about 35-80 mg/mL, about 35-90 mg/mL, about 35-100 mg/mL, about 40-45 mg/mL, about 40-50 mg/mL, about 40-60 mg/mL, about 40-70 mg/mL, about 40-80 mg/mL, about 40-90 mg/mL, about 45-50 mg/mL, about 45-60 mg/mL, about 45-70 mg/mL, about 45-80 mg/mL, about 45-90 mg/mL, about 40-100 mg/mL, about 50-60 mg/mL, about 50-70 mg/mL, about 50-80 mg/mL, about 50-90 mg/mL, about 50-100 mg/mL, about 60-70 mg/mL, about 60-80 mg/mL, about 60-90 mg/mL, about 60-100 mg/mL, about 70-80 mg/mL, about 70-90 mg/mL, about 70-100 mg/mL, about 80-90 mg/mL, about 80-100 mg/mL or about 90-100 mg/mL. In some embodiments, the amount of the peptidomimetic macrocycles in the formulations of the disclosure can be about 1 mg/mL, about 2 mg/mL, about 3 mg/mL, about 4 mg/mL, about 5 mg/mL, about 6 mg/mL, about 7 mg/mL, about 8 mg/mL, about 9 mg/mL, about 10 mg/mL, about 11 mg/mL, about 12 mg/mL, about 13 mg/mL, about 14 mg/mL, about 15 mg/mL, about 16 mg/mL, about 17 mg/mL, about 18 mg/mL, about 19 mg/mL, or about 20 mg/mL. In some embodiments, the amount of the peptidomimetic macrocycles is about 5 mg/mL, about 10 mg/mL, about 15 mg/mL or about 20 mg/mL. In some embodiments, the peptidomimetic macrocycle is a p53-based peptidomimetic macrocycle and the amount is about 1-20 mg/mL, for example about 1.0 mg/mL, about 5 mg/mL, about 10 mg/mL, about 15 mg/mL or about 20 mg/mL.

In some embodiments, the aqueous solution further comprises a buffering agent. In such embodiments, the method of making the aqueous pharmaceutical formulations disclosed herein comprises dissolving at least one buffering agent in the aqueous diluent, and adding at least one peptidomimetic macrocycle or a pharmaceutically acceptable salt thereof. In some embodiments, the peptidomimetic macrocycle is added at once. In some embodiments, the peptidomimetic macrocycle is added slowly over a period of time as described above. As described above, the method can further comprise of stirring the peptide mixture for some additional time.

The concentration of the buffering solution can be about 0.01-100 mM. In some embodiments the concentration of the buffering solution is at least 0.1 mM, 1 mM, 10 mM, 20 mM, 30 mM, 40 mM, 50 mM, 60 mM, 70 mM, 80 mM, 90 mM, 100 mM. In some embodiments the concentration of the buffering solution is at most 0.1 mM, 1 mM, 10 mM, 20 mM, 30 mM, 40 mM, 50 mM, 60 mM, 70 mM, 80 mM, 90 mM, 100 mM. In some embodiments, the concentration of the buffering agent is about 1 mM, 2 mM, 3 mM, 4 mM, 5 mM, 6 mM, 7 mM, 8 mM, 9 mM, 10 mM, 11 mM, 12 mM, 13 mM, 14 mM, 15 mM, 16 mM, 17 mM, 18 mM, 19 mM, 20 mM, 21 mM, 22 mM, 23 mM, 24 mM, 25 mM, 26 mM, 27 mM, 28 mM, 29 mM, 30 mM, 31 mM, 32 mM, 33 mM, 34 mM, 35 mM, 36 mM, 37 mM, 38 mM, 39 mM, 40 mM, 41 mM, 42 mM, 43 mM, 44 mM, 45 mM, 46 mM, 47 mM, 48 mM, 49 mM, 50 mM, 60 mM, 70 mM, 80 mM, 90 mM, or 100 mM.

The method can further involve maintaining the pH of the formulation. For example, maintaining the pH of the reaction medium while the peptidomimetic macrocycle is being added and/or dissolved therein. The pH can be maintained by the addition of a pH adjusting agent. Any suitable pH adjusting agents as described above and throughout the disclosure can be used.

Non-limiting examples of suitable pH adjusting agents which can be included in the methods disclosed herein are hydrochloric acid, sodium hydroxide, citric acid, phosphoric acid, lactic acid, tartaric acid, succinic acid, or mixtures thereof. In one embodiment, the pH adjusting agent is hydrochloric acid. In one embodiment, the pH adjusting agent is sodium hydroxide. In one embodiment, the pH adjusting agent is phosphoric acid. In one embodiment, the pH adjusting agent is lactic acid. In one embodiment, the pH adjusting agent is tartaric acid. In one embodiment, the pH adjusting agent is tartaric acid. In one embodiment, the pH adjusting agent is succinic acid. In one embodiment, the buffering agent is a phosphate buffer and the pH adjusting agent in sodium hydroxide. For example, the buffering agent can be $NaH_2PO_4$ and the pH adjusting agent can be sodium hydroxide, or the buffering agent can be Na$_2$HPO$_4$ and the pH adjusting agent can be sodium hydroxide, other buffering agent can be a mixture of NaH$_2$PO$_4$ and Na$_2$HPO$_4$ and the pH adjusting agent can be sodium hydroxide, or buffering agent can be KH$_2$PO$_4$ and the pH adjusting agent can be sodium hydroxide, or the buffering agent can be K$_2$HPO$_4$ and the pH adjusting agent can be sodium hydroxide, or the buffering agent can be a mixture of KH$_2$PO$_4$ and K$_2$HPO$_4$ and the pH adjusting agent can be sodium hydroxide.

In some embodiments the amount of the pH adjusting agent added to the aqueous pharmaceutical formulation is in the range of about 0.001-1% w/v. For example, in some embodiments, the amount of the pH adjusting agent present is in the range of 0.01-0.1% w/v, 0.1-1% w/v, 0.005-1% w/v, 0.05-1% w/v, 0.5-1% w/v, 0.001-0.5% w/v, 0.01-0.5% w/v, 0.1-0.5% w/v, 0.001-0.1% w/v, or 0.01-0.1 vv. In some embodiments, the amount of the pH adjusting agent present in the formulation is in the range of about 0.01-0.1% w/v. In some embodiments, the amount of the pH adjusting agent present in the formulation is at least 0.01% w/v, 0.02% w/v, 0.03% w/v, 0.04% w/v, 0.05% w/v, 0.06% w/v, 0.07% w/v, 0.08% w/v, 0.09% w/v, or 0.1% w/v. In some embodiments, the amount of the pH adjusting agent present in the formulation is at most 0.1% w/v, 0.09% w/v, 0.08% w/v, 0.07% w/v, 0.06% w/v, 0.05% w/v, 0.04% w/v, 0.03% w/v, 0.02% w/v, 0.01% w/v.

In some embodiments the amount of the pH adjusting agent added to the aqueous pharmaceutical formulation is in the range of about 0.01-100 mg/mL. For example, in some embodiments, the amount of the pH adjusting agent present is in the range of 0.01-50 mg/mL, 0.01-10 mg/mL, 0.1-100 mg/mL, 0.1-50 mg/mL, 0.1-10 mg/mL, 1-100 mg/mL, 1-50 mg/mL, or 1-10 mg/mL. In some embodiments, the amount of the pH adjusting agent present in the formulation is in the range of about 1-10 mg/mL. In some embodiments, the amount of the pH adjusting agent present in the formulation is at least 1 mg/mL, 2 mg/mL, 3 mg/mL, 4 mg/mL, 5 mg/mL, 6 mg/mL, 7 mg/mL, 8 mg/mL, 9 mg/mL, or 10 mg/mL. In some embodiments, the amount of the pH adjusting agent present in the formulation is at most 10 mg/mL, 9 mg/mL, 8 mg/mL, 7 mg/mL, 6 mg/mL, 5 mg/mL, 4 mg/mL, 3 mg/mL, 2 mg/mL, 1 mg/mL. In some embodiments, the amount of the pH adjusting agent present in the formulation is about 1 mg/mL, about 1.5 mg/mL, about 2 mg/mL, about 2.5 mg/mL, about 3 mg/mL, about 3.5 mg/mL, about 4 mg/mL, about 4.5 mg/mL, about 5 mg/mL, about 6 mg/mL, about 7 mg/mL, about 8 mg/mL, about 9 mg/mL, about 10 mg/mL, about 12 mg/mL, about 14 mg/mL, about 16 mg/mL, about 18 mg/mL, or about 20 mg/mL. In some embodiments, the amount of the pH adjusting agent present in the formulation is of the pH adjusting agent is present in about 5 mg/mL of the formulation.

In some embodiments, the aqueous solution comprises a stabilizing agent. In such embodiments, the method of making the aqueous pharmaceutical formulations disclosed herein comprises dissolving at least one stabilizing agent in at least an aqueous diluent, and adding at least one peptidomimetic macrocycle or a pharmaceutically acceptable salt thereof. In some embodiments, the peptidomimetic macrocycle is added at once. In some embodiments, the peptidomimetic macrocycle is added slowly over a period of time as described above. As described above, the method can further comprise of stirring the peptide mixture for some additional time.

In amount of the stabilizing agent in the formulations can be in the range of about 0.001-1% w/v. For example, in the range of about 0.001-0.01%, about 0.001-0.1% w/v, about 0.001-0.5% w/v, about 0.01-0.1% w/v, about 0.01-0.5% w/v, about 0.01-0.1% w/v, about 0.1-0.5% w/v or about 0.5-1% w/v. In some embodiments, the amount of the stabilizing agent in the formulation is about 0.01-0.1% w/v. In some embodiments, the amount of the stabilizing agent is at least about 0.01% w/v, about 0.02% w/v, about 0.03% w/v, about 0.04% w/v, about 0.05% w/v, about 0.06% w/v, about 0.07% w/v, about 0.08% w/v, about 0.09% w/v, or about 0.1% w/v. In some embodiments, the amount of the stabilizing agent is at most about 0.1% w/v, about 0.09% w/v, about 0.08% w/v, about 0.07% w/v, about 0.06% w/v, about 0.05% w/v, about 0.04% w/v, about 0.03% w/v, about 0.02% w/v, about 0.01% w/v. In some embodiments, the amount of the stabilizing agent in the formulation is about 0.01% w/v, about 0.02% w/v, about 0.03% w/v, about 0.04% w/v, about 0.05% w/v, about 0.06% w/v, about 0.07% w/v, about 0.08% w/v, about 0.09% w/v, or about 0.1% w/v. In some embodiments, the amount of the stabilizing agent in the formulation is about 0.01% w/v. In some embodiments, the amount of the stabilizing agent in the formulation is about 0.02% w/v. In some embodiments, the amount of the stabilizing agent in the formulation is about 0.03% w/v. In some embodiments, the amount of the stabilizing agent in the formulation is about 0.04% w/v. In some embodiments, the amount of the stabilizing agent in the formulation is about 0.05% w/v.

In some embodiments the amount of the stabilizing agent is about 0.01-10 mg/mL. For example, in some embodiments, the amount of the stabilizing agent is about 0.01-5 mg/mL, about 0.01-1 mg/mL, about 0.01-0.5 mg/mL, about 0.01-0.1 mg/mL, about 0.1-10 mg/mL, about 0.1-5 mg/mL, about 0.1-1 mg/mL, about 0.1-0.5 mg/mL, about 1-10 mg/mL, or about 1-5 mg/mL. In some embodiments, the amount of the stabilizing agent in the formulation is in the range of about 0.01-1.0 mg/mL.

In some embodiments, the amount of the stabilizing agent is at least about 0.1 mg/mL, about 0.2 mg/mL, about 0.3 mg/mL, about 0.4 mg/mL, about 0.5 mg/mL, about 0.6 mg/mL, about 0.7 mg/mL, about 0.8% mg/mL, about 0.9 mg/mL, or about 1 mg/mL. In some embodiments, the amount of the stabilizing agent is at most about 1 mg/mL, about 0.9 mg/mL, about 0.8 mg/mL, about 0.7 mg/mL, about 0.6 mg/mL, about 0.5 mg/mL, about 0.4 mg/mL, about 0.3 mg/mL, about 0.2 mg/mL, or about 0.1 mg/mL.

In some embodiments, the amount of the stabilizing agent is about 0.1 mg/mL, about 0.2 mg/mL, about 0.3 mg/mL, about 0.4 mg/mL, about 0.5 mg/mL, about 0.6 mg/mL, about 0.7 mg/mL. about 0.8 mg/mL, about 0.9 mg/mL, or about 1 mg/mL. In some embodiments, the amount of the stabilizing agent in the formulation is about 0.1 mg/mL. In some embodiments, the amount of the stabilizing agent in the formulation is about 0.2 mg/mL. In some embodiments, the amount of the stabilizing agent in the formulation is about 0.3 mg/mL. In some embodiments, the amount of the stabilizing agent in the formulation is about 0.4 mg/mL. In some embodiments, the amount of the stabilizing agent in the formulation is about 0.5 mg/mL.

In some embodiments, the aqueous solution comprises both a buffering agent and stabilizing agent. In such embodiments, the method of making the aqueous pharmaceutical formulations disclosed herein comprises dissolving at least one stabilizing agent and at least one buffering agent in an aqueous diluent, and adding at least one peptidomimetic macrocycle or a pharmaceutically acceptable salt thereof. In some embodiments, the peptidomimetic macrocycle is added at once. In some embodiments, the peptidomimetic macrocycle is added slowly over a period of time as described above. As described above, the method can further comprise of stirring the peptide mixture for some additional time.

In some examples, the method of making the aqueous pharmaceutical formulations disclosed herein comprises dissolving at least one buffering agent, at least one tonicity adjusting agent and at least one stabilizing agent in at least one aqueous diluent, and adding at least one peptidomimetic macrocycle or a pharmaceutically acceptable salt thereof. In some embodiments, the buffering agent, the tonicity adjusting agent and the stabilizing agents are dissolved in the aqueous diluent in this order. In some embodiments, the peptidomimetic macrocycle is added at once. In some embodiments, the peptidomimetic macrocycle is added slowly over a period of time as described above.

The amount of the tonicity adjusting agent in the aqueous pharmaceutical formulations disclosed herein can be in the range of about 0.001-50% w/v, for example about 0.001-0.1% w/v, about 0.001-1.0% w/v, about 0.001-10% w/v, about 1-10% w/v, about 1-20% w/v, about 1-30% w/v, about 1-40% w/v, about 1-50% w/v, about 5-10% w/v, about 5-20% w/v, about 5-30% w/v, about 5-40% w/v, about 5-50% w/v, about 10-20% w/v, about 10-30% w/v, about 10-40% w/v, about 10-50% w/v, about 15-20% w/v, about 15-30% w/v, about 15-40% w/v, about 15-50% w/v, about 20-30% w/v, about 20-40% w/v, about 20-50% w/v, about 25-30% w/v, about 25-40% w/v, about 25-50% w/v, about 30-40% w/v, about 30-50,% w/v, about 35-40% w/v, about 35-50% w/v, about 40-50% w/v, or about 45-50% w/v. In some embodiments, the amount of the tonicity adjusting agent is about 1% w/v, about 2% w/v, about 3% w/v, about 4% w/v, about 5% w/v, about 6% w/v, about 7% w/v, about 8% w/v, about 9% w/v, or about 10% w/v. In some embodiments, the amount of the tonicity adjusting agent is about 7% w/v. In some embodiments, the amount of the tonicity adjusting agent is about 8% w/v. In some embodiments, the amount of the tonicity adjusting agent is about 9% w/v. In some embodiments, the amount of the tonicity adjusting agent is about 10% w/v.

The concentration of the tonicity adjusting agent can vary in the range of about 1-500 mg/mL. For example, the concentration of the tonicity adjusting agent in the aqueous pharmaceutical formulations disclosed herein can be in the range of about 1-400 mg/mL, 1-300 mg/mL, 1-200 mg/mL, 1-100 mg/mL, 10-500 mg/mL, 10-400 mg/mL, 10-300 mg/mL, 10-200 mg/mL, 10-100 mg/mL, 20-500 mg/mL, 20-400 mg/mL, 20-300 mg/mL, 20-200 mg/mL, 20-100 mg/mL, 30-500 mg/mL, 30-400 mg/mL, 30-300 mg/mL, 30-200 mg/mL, 30-100 mg/mL, 40-500 mg/mL, 40-400 mg/mL, 40-300 mg/mL, 40-200 mg/mL, 40-100, mg, 50-500 mg/mL, 50-400 mg/mL, 50-300 mg/mL, 50-200 mg/mL, 50-100 mg/mL, 60-500 mg/mL, 60-400 mg/mL, 60-30 mg/mL, 60-200 mg/mL, 60-100 mg/mL, 70-500 mg/mL, 70-400 mg/mL, 70-300 mg/mL, 70-200 mg/mL, 70-100 mg/mL, 80-500 mg/mL, 80-400 mg/mL, 80-300 mg/mL, 80-200 mg/mL, 80-200 mg/mL, 90-500 mg/mL, 90-400 mg/mL, 90-300 mg/mL, 90-200 mg/mL, 90-100 mg/mL, 100-500 mg/mL, 100-400 mg/mL, 100-300 mg/mL, 100-200 mg/mL, 200-500 mg/mL, 200-400 mg/mL, 200-300 mg/mL, 300-500 mg/mL, 300-400 mg/mL or 400-500 mg/mL. In some embodiments, the concentration of the tonicity adjusting agent is about 10 mg/mL, about 20 mg/mL, about 30 mg/mL, about 40 mg/mL, about 50 mg/mL, about 60 mg/mL, about 70 mg/mL, about 80 mg/mL, about 90 mg/mL, or about 100 mg/mL. In some embodiments, the concentration of the tonicity adjusting agent is about 50 mg/mL. In some embodiments, the concentration of the tonicity adjusting agent is about 80 mg/mL. In some embodiments, the concentration of the tonicity adjusting agent is about 100 mg/mL. In some embodiments, the tonicity adjusting agent is trehalose (for example, D-trehalose) and the concentration is about 80 mg/mL.

In some embodiments, the concentration of the tonicity adjusting agent is between about 100-500 mM. For example the concentration of the tonicity adjusting agent in the aqueous pharmaceutical formulations disclosed herein can be 100-400 mM, 100-300 mM, 100-200 mM, 200-500 mM, 200-400 mM, 200-300 mM, 300-500 mM, 300-400 mM or 400-500 mM. In some embodiments, the concentration of the tonicity adjusting agent is between about 200-300 mM, for example 210-300 mM, 220-300 mM, 230-300 mM, 240-300 mM, 250-300 mM, 260-300 mM, 270-300 mM, 280-300 mM, 290-300 mM, 200-290 mM, 210-290 mM, 220-290 mM, 230-290 mM, 240-290 mM, 250-290 mM, 260-290 mM, 270-290 mM, 280-290 mM, 200-280 mM, 210-280 mM, 220-280 mM, 230-280 mM, 240-280 mM, 250-280 mM, 260-280 mM, 270-280 mM, 200-270 mM, 210-270 mM, 220-270 mM, 230-270 mM, 240-270 mM, 250-270 mM, 260-270 mM, 200-260 mM, 210-260 mM, 220-260 mM, 230-260 mM, 240-260 mM, 250-260 mM, 200-250 mM, 210-250 mM, 220-250 mM, 230-250 mM, 240-250 mM, 200-240 mM, 210-240 mM, 220-240 mM, 230-240 mM, 200-230 mM, 210-230 mM, 220-230 mM, 200-220 mM, 210-220 mM, or 210-220 mM. In some embodiments, the concentration of the tonicity adjusting agent is between about 220-260 mM. For example, about 220 mM, 230 mM, 240 mM, 250 mM, or 260 mM.

The methods described herein can additionally comprise addition of one or more optional excipients and/or ingredients. For example addition of one or more antioxidants, antimicrobial agent, surfactants, lubricants, thickening agents, preservatives, chelating agents.

In some embodiments the amount of antioxidants used is in the range of about 0.001-5% w/v, for example about 0.001-4.5%, 0.001-4%, 0.001-3%, 0.001-2%, 0.002-1%, 0.001-0.5%, or 0.001-0.05% w/v. In some embodiments the amount of antioxidants used is in the range of about 0.001-about 0.5%, about 0.1-about 0.5%, about 0.2-about 0.5%, about 0.3-about 0.5%, about 0.4-about 0.5%, about 0.01-about 0.4%, about 0.1-about 0.4%, about 0.2-about 0.4%, about 0.3-about 0.4%, about 0.01-about 0.3%, about 0.1-about 0.3%, about 0.2-about 0.3%, about 0.01-about 0.2%, about 0.1-about 0.2%, or about 0.01-about 0.1% w/v.

Such antimicrobial agents can be employed at a level of from about 0.005-0.5% w/v, for example about 0.001-0.01% w/v, about 0.01-0.1% w/v, about 0.1-0.5% w/v or about 0.01-0.05% w/v.

The methods described herein can additionally comprise prefiltering and/or clarifying the peptidomimetic formulation by a suitable process, for example by centrifugation or by filtration. Filtration can be by any suitable means, for example by depth filter media or by membrane filters. In some embodiments, filtration can be by means of a 0.22 micrometer filters.

The method can optionally involve sterilization of the aqueous pharmaceutical formulations. Sterilization can be performed by any suitable technique. For example, a suitable sterilization method can include one or more of sterile filtration, chemical, irradiation heat filtration, and addition of a chemical disinfectant to the aqueous pharmaceutical formulation. In some examples, the formulations are sterilized by moist heat sterilization. In some examples, the formulations are sterilized by dry heat sterilization. In some examples, the formulations are sterilized by chemical cold sterilization. In some examples, the formulations are sterilized by radiation sterilization. In some examples, the formulations are sterilized by filtration. In some examples, the formulations are sterilized by filtration using an appropriate micron sterilizing grade filters. The filtration can be carried out by any suitable means, e.g. cellulose-based filters, cellulosic esters (MCE), polyvinylidene fluoride (PVDF), polytetrafluoroethylene (PTFE), or polyethersulfone (PES) filters. In some embodiments PVDF filters are used. Filters of any appropriate micron size can be used. In some embodiments, the filter size can be 0.001-0.5 micrometer, for example 0.001-0.01 micrometer, 0.01-0.1 micrometer, 0.1-0.2 micrometer, 0.2-0.3 micrometer, 0.3-0.4 3 micrometer or 0.4-0.5 micrometer. In some embodiments 0.22 micrometer filters are used. In some embodiments 0.22 micrometer PVDF filters are used.

The aqueous pharmaceutical formulations can be in a form that is suitable for direct administration or can be in a concentrated form that requires dilution relative to what is administered to the patient. For example, aqueous pharmaceutical formulations, described in this disclosure, can be in a form that is suitable for direct administration without any further dilution or reconstitution. The formulations can be diluted or reconstituted prior to administration with a suitable aqueous diluent(s) to obtain a finished concentration. The diluent can be an injection or infusion fluid. Examples of injection or infusion fluid include, but are not limited to, WFI (Bacteriostatic Water For Injection), SWFI (Sterile Water For Injection), D5W (Dextrose 5% in Water), D10W (Dextrose 10% in Water), D5LR (Dextrose in Lactate Ringer's Solution), D5 ¼S (Dextrose 5% in ¼ Strength Saline (5% Dextrose and 0.22% Sodium Chloride Injection)), D5 ½S (Dextrose 5% in ½ Strength Saline (5% Dextrose and 0.45% Sodium Chloride Injection)), D5NS (Dextrose 5% in Normal Saline (5% Dextrose and 0.9% Sodium Chloride Injection)), D5R (Dextrose 5% in Ringer's Injection), DlONS (Dextrose 10% in Normal Saline (10% Dextrose and 0.9% Sodium Chloride Injection)), ISlOW (Invert Sugar 10% in Saline (10% Invert Sugar in 0.9% Sodium Chloride Injection)), LR (Lactated Ringer's Injection), Pr (Protein Hydrolysate Injection), R (Ringer's Injection), NS Sodium Chloride 0.9% (Normal Saline), SOD CL 5 (Sodium Chloride 5% (5% Sodium Chloride Injection), and Sod Lac (Sodium Lactate, 1/6 Molar (M/6 Sodium Lactate Injection)). In some examples, the formulations can be diluted with 0.9% sodium chloride, 5% dextrose in water (D5W), 5% dextrose in normal saline (D5NS), 5 dextrose in half amount of normal saline (D5 ½NS), lactated ringer's injection or a mixture thereof. Dilution/reconstitution can be performed immediately prior to the administration. In some cases, dilution/reconstitution can be performed shortly before the administration. In some cases, the dilution is performed at most 1 min, 5 min, 15 min, 30 min, 45 min, 60 min, 90 min, 2 h, 3 h, 4 h, 5 h, 6 h, 7 h, 8 h, 9 h, 10 h, 11 h, 12 h, 13 h, 14 h, 15 h, 16 h, 17 h, 18 h, 19 h, 20 h, 21 h, 22 h, 23 h, or 24 h before the administration to the subject. In some examples the reconstituted and diluted solutions is used within 1-10 hours, 2-8 hours, 3-7 hours, 4-6 hours reconstitution and/or dilution. In some examples, the formulations are diluted/reconstituted more than 1 day, 2 days, 3 days, 4 days, 5 days, 6 days, 1 week before administration. FIG. 1 depicts the manufacturing process of an exemplary aqueous formulation according to the disclosure.

Purity, Stability and Degradation

The formulations of the disclosure can be characterized by low endotoxin concentration. In some embodiments, the formulations can have a concentration of endotoxin of less than about 100 EU/mL, for example, less than about 90 EU/mL, 80 EU/mL, 70 EU/mL, 60 EU/mL, 50 EU/mL, 40 EU/mL, 30 EU/mL, 20 EU/mL, 10 EU/mL, 5 EU/mL, 1 EU/mL, 0.5 EU/mL, 0.2 EU/mL, 0.1 EU/mL, 0.05 EU/mL, 0.01 EU/mL, 0.005 EU/mL, or 0.001 EU/mL. In some embodiments the concentration of the endotoxin is 0.1-10 EU/mL, for example about 0.1-1 EU/mL, 0.1-2 EU/mL, 0.1-3 EU/mL, 0.1-4 EU/mL, 0.1-5 EU/mL, 0.1-6 EU/mL, 0.1-7 EU/mL, 0.1-8 EU/mL, 0.1-9 EU/mL, 1-2 EU/mL, 1-3 EU/mL, 1-4 EU/mL, 1-5 EU/mL, 1-6, 1-7, 1-8, 1-9, 1-10, 2-3 EU/mL, 2-4 EU/mL, 2-5 EU/mL, 2-6, 2-7, 2-8, 2-9, 2-10, 3-4 EU/mL, 3-5 EU/mL, 3-6 EU/mL, 3-7 EU/mL, 3-8 EU/mL, 3-9 EU/mL, 3-10 EU/mL, 4-5 EU/mL, 4-6 EU/mL, 4-7 EU/mL, 4-8 EU/mL, 4-9 EU/mL, 4-10 EU/mL, 5-6 EU/mL, 5-7 EU/mL, 5-8 EU/mL, 5-9 EU/mL, 5-10 EU/mL, 6-7 EU/mL, 6-8 EU/mL, 6-9 EU/mL, 6-10 EU/mL, 7-8 EU/mL, 7-9 EU/mL, 7-10 EU/mL, 8-9 EU/mL, 8-10 EU/mL, or 9-10 EU/mL.

In some embodiments the formulations of the disclosure are essentially particulate-free solutions. In some embodiments, the formulation is essentially free of particles of size greater than about 1 µm, 2 µm, 3 µm, 4 µm, 5 µm, 6 µm, 7 µm, 8 µm, 9 µm, 10 µm, 11 µm, 12 µm, 13 µm, 14 µm, 15 µm, 16 µm, 17 µm, 18 µm, 19 µm, 20 µm, 21 µm, 22 µm, 23 µm, 24 µm, 25 µm, 26 µm, 27 µm, 28 µm, 29 µm, 30 µm, 35 µm, 40 µm, 45 µm, 50 µm, or more.

In some embodiments, the formulation comprise at most about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 50, about 100, about 200, about 300, about 400, about 500, about 600, about 700, about 800, about 900, about 1,000, about 1,100, about 1,200, about 1,300, about 1,400, about 1,500, about 1,600, about 1,700, about 1,800, about 1,900, about 2,000, about 2,200, about 2,400, about 2,600, about 2,800, about 3,000, about 3,500, about 4,000, about 4,500, about 5,000, about 5,500, about 6,000, about 6,500, about 7,000, about 8,000, about 8,500, about 9,000, about 9,500, or about 10,000 particles of size greater than or equal to 10 µm per 1 mL or 5 mL of formulation. In some embodiments the formulations of the disclosure are essentially free of particles of size greater than or equal to 10 µm. In some embodiments the formulations of the disclosure less than 500 particles of size greater than or equal to 10 µm in per 1 mL or 5 mL of formulation. In some embodiments the formulations of the disclosure less than 1000 particles of size greater than or equal to 10 µm in per 1 mL or 5 mL of formulation. In some embodiments the formulations of the disclosure less than 1200 particles of size greater than or equal to 10 µm in per 1 mL or 5 mL of formulation. In some embodiments the formulations of the disclosure less than 1,000-1,200 particles of size greater than or equal to 10 µm in per 1 mL or 5 mL of formulation.

In some embodiments, the formulation comprise at most about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 50, about 60, about 70, about 80, about 90, about 100, about 110, about 120, about 130, about 140, about 150, about 200, about 300, about 400, about 500, about 600, about 700, about 800, about 900, about 1,000, about 1,100, about 1,200, about 1,300, about 1,400, about 1,500, about 1,600, about 1,700, about 1,800, about 1,900, about 2,000, about 2,500, about 3,000, about 3,500, about 4,000, about 4,500, about 5,000, about 5,500, or about 6,000 particles of size greater than or equal to 25 µm per 1 mL or 5 mL of formulation. In some embodiments the formulations of the disclosure are essentially free of particles of size greater than or equal to 25 µm. In some embodiments the formulations comprise at most 50 particles of size greater than or equal to 25 µm per 1 mL or 5 mL of formulation. In some embodiments the formulations comprise at most 100 particles of size greater than or equal to 25 µm per 1 mL or 5 mL of formulation. In some embodiments the formulations comprise at most 120 particles of size greater than or equal to 25 µM in per 1 mL or 5 mL of formulation. In some embodiments the formulations comprise about 100-120 particles of size greater than or equal to 25 µm per 1 mL or 5 mL of formulation.

In some embodiments the formulations of the disclosure are essentially free of particles of size greater than or equal to 50 µm. In some embodiments the formulations comprise at most 1 particles of size greater than or equal to 50 µm per 1 mL or 5 mL of formulation. In some embodiments the formulations comprise at most 2 particles of size greater than or equal to 50 µm per 1 mL or 5 mL of formulation. In some embodiments the formulations comprise at most 3 particles of size greater than or equal to 50 µm in per 1 mL or 5 mL of formulation. In some embodiments the formulations comprise about 1-5 particles of size greater than or equal to 50 µm per 1 mL or 5 mL of formulation. In some embodiments the formulations of the disclosure are essentially free of particles of size greater than or equal to 50 µm. In some embodiments the formulations comprise at most 1 particles of size greater than or equal to 50 µm per container. In some embodiments the formulations comprise at most 2 particles of size greater than or equal to 50 µm per container. In some embodiments the formulations comprise at most 3 particles of size greater than or equal to 50 µm in per container. In some embodiments the formulations comprise about 1-5 particles of size greater than or equal to 25 µm container.

In some embodiments, the formulations comprise 0-10000, 100-10,000, 500-10,000, 1,000-10,000, 1,500-10,000, 2,000-10,000, 2,500-10,000, 3,000-10,000, 3,500-10,000, 4,000-10,000, 4,500-10,000, 5,000-10,000, 5,500-10,000, 6,000-10,000, 6,500-10,000, 7,000-10,000, 7,500-10,000, 8,000-10,000, 8,500-10,000, 9,000-10,000, or 9,500-10,000 particles of size greater than or equal to 10 µm per mL of formulation.

In some embodiments, the formulations comprise 0-10000, 100-10,000, 500-10,000, 1,000-10,000, 1,500-10,000, 2,000-10,000, 2,500-10,000, 3,000-10,000, 3,500-10,000, 4,000-10,000, 4,500-10,000, 5,000-10,000, 5,500-10,000, 6,000-10,000, 6,500-10,000, 7,000-10,000, 7,500-10,000, 8,000-10,000, 8,500-10,000, 9,000-10,000, or 9,500-10,000 particles of size greater than or equal to 10 µm per 5 mL of formulation.

In some embodiments, the formulations comprise 0-10000, 100-10,000, 500-10,000, 1,000-10,000, 1,500-10,000, 2,000-10,000, 2,500-10,000, 3,000-10,000, 3,500-10,000, 4,000-10,000, 4,500-10,000, 5,000-10,000, 5,500-10,000, 6,000-10,000, 6,500-10,000, 7,000-10,000, 7,500-10,000, 8,000-10,000, 8,500-10,000, 9,000-10,000, or 9,500-10,000 particles of size greater than or equal to 25 µm per mL of formulation.

In some embodiments, the formulations comprise 0-10000, 100-10,000, 500-10,000, 1,000-10,000, 1,500-10,000, 2,000-10,000, 2,500-10,000, 3,000-10,000, 3,500-10,000, 4,000-10,000, 4,500-10,000, 5,000-10,000, 5,500-10,000, 6,000-10,000, 6,500-10,000, 7,000-10,000, 7,500-10,000, 8,000-10,000, 8,500-10,000, 9,000-10,000, or 9,500-10,000 particles of size greater than or equal to 25 µm per 5 mL of formulation.

In some embodiments, the formulations comprise 0-10000, 100-10,000, 500-10,000, 1,000-10,000, 1,500-10,000, 2,000-10,000, 2,500-10,000, 3,000-10,000, 3,500-10,000, 4,000-10,000, 4,500-10,000, 5,000-10,000, 5,500-10,000, 6,000-10,000, 6,500-10,000, 7,000-10,000, 7,500-10,000, 8,000-10,000, 8,500-10,000, 9,000-10,000, or 9,500-10,000 particles of size greater than or equal to 50 µm per 1 mL of formulation.

In some embodiments, the formulations comprise 0-10000, 100-10,000, 500-10,000, 1,000-10,000, 1,500-10,000, 2,000-10,000, 2,500-10,000, 3,000-10,000, 3,500-10,000, 4,000-10,000, 4,500-10,000, 5,000-10,000, 5,500-10,000, 6,000-10,000, 6,500-10,000, 7,000-10,000, 7,500-10,000, 8,000-10,000, 8,500-10,000, 9,000-10,000, or 9,500-10,000 particles of size greater than or equal to 50 µm per 5 mL of formulation.

In some embodiments, the formulations of the present disclosure can remain stable after exposure to a single or multiple freeze-thaw events. Formulations of the present disclosure can also remain stable after exposure to physical agitation, such as one would expect to encounter upon shipping product from one location to another. Stability can be measured by any one of a number of different ways, including visual inspection for precipitate formation, analysis of percent peptidomimetic macrocycle remaining in solution after exposure to stress conditions (e.g., by size-exclusion HPLC), or analysis of the formation of chemical variants and/or decomposition products of the peptidomimetic macrocycle (e.g., by anion exchange or reverse phase HPLC analysis). In some embodiments of the present disclosure, no precipitate visible to the naked eye is formed in the formulation after at least one freeze thaw event. In some embodiments the formulation remains stable after at least three freeze thaw events. In some embodiments the formulation remains stable after at least six freeze thaw events. In some embodiments, at least 80, 85, 90%, 95%, 96%, 975, 98%, or 99% of the peptidomimetic macrocycle remains in the formulation after at least one freeze thaw event.

In some embodiments, the total peptidomimetic degradation products formed in the formulations of the present disclosure is less than 1.0% when stored at a temperature of 40° C. for a period of one month. In some further embodiments, the total degradation products of the compound of Formula 1 formed is less than about 0.9%, about 0.8%, about 0.7%, about 0.6%, about 0.5%, about 0.4%, about 0.3%, about 0.2%, or about 0.1% when stored at a temperature of 40° C. for a period of one month.

In some embodiments, the total peptidomimetic degradation products formed in the formulations of the present disclosure is less than 1.0% when stored at a temperature of 40° C. for a period of about two months, about three months, about four months, about five months about six months.

In some further embodiments, the amount of any single impurity in the formulation at any storage temperature is less than 0.001%, 0.01%, 0.1%, 0.5%, 1.0%, 1.5%, 2.0%, 2.5%, 3.0%, 3.5%, 4.0%, 4.5%, 5.0%, 5.5%, 6.0%, 6.5%, 7.0%, 7.5%, 8.0%, 8.5%, 9.0%, 9,5%, or 10%. In some further embodiments, the amount of any single impurity in the formulation at any storage temperature is less than 1.0%. In some further embodiments, the amount of any single impurity in the formulation at any storage temperature is less than 2.0%. In some further embodiments, the amount of any single impurity in the formulation at any storage temperature is less than 3.0%. In some further embodiments, the amount of any single impurity in the formulation at any storage temperature is less than 4.0%. In some further embodiments, the amount of any single impurity in the formulation at any storage temperature is less than 5.0%.

In some further embodiments, the amount of any single impurity in the formulation at any storage temperature is less than 0.5% when stored at a temperature of −20° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 1% when stored at a temperature of −20° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 1.5% when stored at a temperature of −20° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 2.0% when stored at a temperature of −20° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 2.5% when stored at a temperature of −20° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 3.0% when stored at a temperature of −20° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 5.0% when stored at a temperature of −20° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months.

In some further embodiments, the amount of any single impurity in the formulation at any storage temperature is less than 0.5% when stored at a temperature of 5° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 1% when stored at a temperature of 5° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 1.5% when stored at a temperature of 5° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 2.0% when stored at a temperature of 5° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 2.5% when stored at a temperature of 5° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 3.0% when stored at a temperature of 5° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 5.0% when stored at a temperature of 5° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months.

In some further embodiments, the amount of any single impurity in the formulation at any storage temperature is less than 0.5% when stored at a temperature of 25° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 1% when stored at a temperature of 25° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 1.5% when stored at a temperature of 25° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 2.0% when stored at a temperature of 25° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 2.5% when stored at a temperature of 25° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 3.0% when stored at a temperature of 25° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 5.0% when stored at a temperature of 25° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months.

In some further embodiments, the amount of any single impurity in the formulation at any storage temperature is less than 0.5% when stored at a temperature of 40° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 1% when stored at a temperature of 40° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 1.5% when stored at a temperature of 40° C. for a period of 0 months, 0.5 months, 1.0 months, 1.5 months, 2.0 months, 2.5 months, 3.0 months. 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 2.0% when stored at a temperature of 40° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 2.5% when stored at a temperature of 40° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 3.0% when stored at a temperature of 40° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months. In some further embodiments, the amount of any single impurity in the formulation at any storage temperature is less than 5.0% when stored at a temperature of 40° C. for a period of 0 months, 0.5 months, 1.0 months, 1.5 months, 2.0 months, 2.5 months, 3.0 months, 3.5 months, 4.0 months, 4.5 months, 5.0 months, 5.5 months, 6.0 months, 8 months, 10 months, 12 months, or more months.

In some cases the pharmaceutically acceptable formulation expires in about 1-5 years. In some cases the formulation expires in about 1, 2, 3 or 4 years. In some cases the formulation expires in more than 5 years. In some cases the formulation expires in less than a year. In some cases the formulation expires in 1, 2, 3, 4, 5, 6, 7, 8, 9, 10, or 11 months.

In some cases the total amount of peptidomimetic degradation products at the time of product expiration are in the range of above 0.1-10%. In some cases the total degradation product at the time of expiration is in the range of about 0.01-1, about 0.01-2, about 0.01-3, about 0.01-4, about 0.01-5, about 0.01-6, about 0.01-7, about 0.01-8, or about 0.01-9, about 1-2, about 1-3, about 1-4, about 1-5, about 1-6, about 1-7, about 1-8, about 1-9, about 2-3, about 3-4, about 2-5, about 2-6, about 2-7, about 2-8, about 2-9, about 3-4, about 3-5, about 3-6, about 3-7, about 3-8, about 3-9, about 3-10, about 4-5, about 4-6, about 4-7, about 4-8, about 4-9, about 4-10, about 5-6, about 5-7, about 5-8, about 5-9, about 5-10, about 6-7, about 6-8, about 6-9, about 6-10, about 7-8, about 7-9, about 7-10, about 8-9, about 8-10 or about 9-10%. In some embodiments the amount of total degradation product at the time of expiration is about 1%, about 2%, about 3%, about 4%, about 5%, about 6%, about 7%, about 8%, about 9%, about 10%. In some embodiments the amount of total degradation product at the time of expiration is about 0.01%, about 0.05%, about 0.1%, about 0.15%, about 0.2%, about 0.25%, about 0.3%, about 0.35%, about 0.40%, about 0.45%, about 0.50%, about 0.55%, about 0.60%, about 0.65%, about 0.70%, about 0.75%, about 0.80%, about 0.85%, about 0.90%, about 0.95%, or about 1.0%.

In some cases aqueous pharmaceutical formulations of the instant disclosure are stored at −40 to 65° C., for example from −5 to 40° C. In some cases the formulations can be stored at about −40° C., about −30° C., −20° C., −10° C., −5° C., 0° C., about 5° C., about 10° C., about 15° C., about 20° C., about 25° C., about 30° C., about 35° C., about 40° C., about 45° C., about 50° C., about 55° C., about 60° C., or about 65° C. In some embodiments, the formulations are stored at or below ambient temperature. In some embodiments, the formulations are stored above ambient temperature.

Sparging

In some embodiments the stability of the peptidomimetic macrocycles in the formulations of the disclosure can be improved by sparging the formulation with an inert gas. A variety of inert gases can be used as a sparging material including but not limited to nitrogen, argon, helium, or a combination thereof. In some embodiments the inert gas is nitrogen. The sparging is generally carried out till the oxygen is reduced or completely removed from the formulations peptidomimetic macrocycles. The time period for sparging depends in several factors including the amount of formulation, the effectiveness of agitation and the flow rate of the inert gas. In some embodiments, sparging is done by bubbling the inert gas through the formulations for a period of about 1 min-12 h. In some embodiments the formulations are sparged for a period of about 1 min-about 11 h, about 1 min-about 10 h, about 1 min-9 h, about 1 min-8 h, about 1 min-7 h, about 1 min-6 h, about 1 min-5 h, about 1 min-4 h, about 1 min-3 h, about 1 min-2 h, about 1 min-1 h, about 1 min-45 min, about 1 min-about 30 min, about 1 min-15 min, about 1 min-10 min, about 1 min-about 9 min, about 1 min-8 min, about 1 min-about 7 min, about 1 min-6 min, about 1 min-about 5 min, about 1 min-about 4 min, about 1 min-about 3 min, about 1 min-about 2 min. In some embodiments, sparging is performed for less than about 1 minute.

Methods of Use
Methods

In one aspect, provided herein are aqueous pharmaceutical formulations that are useful in competitive binding assays to identify agents which bind to the natural ligand(s) of the proteins or peptides upon which the peptidomimetic macrocycles are modeled. For example, in the p53/MDMX system, labeled peptidomimetic macrocycles based on p53 can be used in a MDMX binding assay along with small molecules that competitively bind to MDMX. Competitive binding studies allow for rapid in vitro evaluation and determination of drug candidates specific for the p53/MDMX system. Such binding studies can be performed with any of the peptidomimetic macrocycles disclosed herein and their binding partners.

Further provided are methods for the generation of antibodies against the peptidomimetic macrocycles. In some embodiments, these antibodies specifically bind both the peptidomimetic macrocycle and the precursor peptides, such as p53, to which the peptidomimetic macrocycles are related. Such antibodies, for example, disrupt the native protein-protein interaction, for example, binding between p53 and MDMX.

In other aspects, provided herein are both prophylactic and therapeutic methods of treating a subject at risk of (or susceptible to) a disorder or having a disorder associated with aberrant (e.g., insufficient or excessive) expression or activity of the molecules including p53, MDM2 or MDMX.

In another embodiment, a disorder is caused, at least in part, by an abnormal level of p53 or MDM2 or MDMX, (e.g., over or under expression), or by the presence of p53 or MDM2 or MDMX exhibiting abnormal activity. As such, the reduction in the level and/or activity of p53 or MDM2 or MDMX, or the enhancement of the level and/or activity of p53 or MDM2 or MDMX, by peptidomimetic macrocycles derived from p53, is used, for example, to ameliorate or reduce the adverse symptoms of the disorder.

In another aspect, provided herein are methods for treating or preventing a disease including hyperproliferative disease and inflammatory disorder by interfering with the interaction or binding between binding partners, for example, between p53 and MDM2 or p53 and MDMX. These methods comprise administering an effective amount of a compound to a warm blooded animal, including a human. In some embodiments, the administration of one or more compounds disclosed herein induces cell growth arrest or apoptosis.

As used herein, the term "treatment" is defined as the application or administration of a therapeutic agent to a patient, or application or administration of a therapeutic agent to an isolated tissue or cell line from a patient, who has a disease, a symptom of disease or a predisposition toward a disease, with the purpose to cure, heal, alleviate, relieve, alter, remedy, ameliorate, improve or affect the disease, the symptoms of disease or the predisposition toward disease.

Disease and Disorders

In some embodiments, the pharmaceutical formulations can be used to treat, prevent, and/or diagnose cancers and neoplastic conditions. As used herein, the terms "cancer", "hyperproliferative" and "neoplastic" refer to cells having the capacity for autonomous growth, i.e., an abnormal state or condition characterized by rapidly proliferating cell growth. Hyperproliferative and neoplastic disease states can be categorized as pathologic, i.e., characterizing or constituting a disease state, or can be categorized as non-pathologic, i.e., a deviation from normal but not associated with a disease state. The term is meant to include all types of cancerous growths or oncogenic processes, metastatic tissues or malignantly transformed cells, tissues, or organs, irrespective of histopathology type or stage of invasiveness. A metastatic tumor can arise from a multitude of primary tumor types, including but not limited to those of breast, lung, liver, colon and ovarian origin. "Pathologic hyperproliferative" cells occur in disease states characterized by malignant tumor growth. Examples of non-pathologic hyperproliferative cells include proliferation of cells associated with wound repair. Examples of cellular proliferative and/or differentiative disorders include cancer, e.g., carcinoma, sarcoma, or metastatic disorders. In some embodiments, the pharmaceutical formulations can be used for controlling/treating breast cancer, ovarian cancer, colon cancer, lung cancer, metastasis of such cancers and the like.

Examples of cancers or neoplastic conditions include, but are not limited to, a fibrosarcoma, myosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, gastric cancer, esophageal cancer, rectal cancer, pancreatic cancer, ovarian cancer, prostate cancer, uterine cancer, cancer of the head and neck, skin cancer, brain cancer, squamous cell carcinoma, sebaceous gland carcinoma, papillary carcinoma, papillary adenocarcinoma, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular cancer, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma, leukemia, lymphoma, Kaposi sarcoma, or glioblastoma multiforme.

In some embodiments, the cancer is head and neck cancer, melanoma, lung cancer, breast cancer, or glioma.

In some examples, the cancer is pancreatic cancer, bladder cancer, colon cancer, liver cancer, colorectal cancer (colon cancer or rectal cancer), breast cancer, prostate cancer, renal cancer, hepatocellular cancer, lung cancer, ovarian cancer, cervical cancer, gastric cancer, esophageal cancer, head and neck cancer, melanoma, neuroendocrine cancers, CNS cancers, brain tumors, bone cancer, skin cancer, ocular tumor, choriocarcinoma (tumor of the placenta), sarcoma or soft tissue cancer.

In some examples, cancer is bladder cancer, bone cancer, breast cancer, cervical cancer, CNS cancer, colon cancer, ocular tumor, renal cancer, liver cancer, lung cancer, pancreatic cancer, choriocarcinoma (tumor of the placenta), prostate cancer, sarcoma, skin cancer, soft tissue cancer or gastric cancer.

In some examples, the cancer is breast cancer. Non limiting examples of breast cancer that can be treated by the instant pharmaceutical formulations include ductal carcinoma in situ (DCIS or intraductal carcinoma), lobular carcinoma in situ (LCIS), invasive (or infiltrating) ductal carcinoma, invasive (or infiltrating) lobular carcinoma, inflammatory breast cancer, triple-negative breast cancer, paget disease of the nipple, phyllodes tumor (phylloides tumor or cystosarcoma phyllodes), angiosarcoma, adenoid cystic (or adenocystic) carcinoma, low-grade adenosquamous carcinoma, medullary carcinoma, papillary carcinoma, tubular carcinoma, metaplastic carcinoma, micropapillary carcinoma, and mixed carcinoma.

In some examples, the cancer is bone cancer. Non limiting examples of bone cancer that can be treated by the instant pharmaceutical formulations include osteosarcoma, chondrosarcoma, the Ewing Sarcoma Family of Tumors (ESFTs).

In some examples, the cancer is skin cancer. Non limiting examples of skin cancer that can be treated by the instant pharmaceutical formulations include melanoma, basal cell skin cancer, and squamous cell skin cancer.

In some examples, the cancer is ocular tumor. Non limiting examples of ocular tumor that can be treated by the pharmaceutical formulations of the instant disclosure include ocular tumor is choroidal nevus, choroidal melanoma, choroidal metastasis, choroidal hemangioma, choroidal osteoma, iris melanoma, uveal melanoma, melanocytoma, metastasis retinal capillary hemangiomas, congenital hypertrophy of the RPE, RPE adenoma or retinoblastoma.

Examples of proliferative disorders include hematopoietic neoplastic disorders. As used herein, the term "hematopoietic neoplastic disorders" includes diseases involving hyperplastic/neoplastic cells of hematopoietic origin, e.g., arising from myeloid, lymphoid or erythroid lineages, or precursor cells thereof. The diseases can arise from poorly differentiated acute leukemias, e.g., erythroblastic leukemia and acute megakaryoblastic leukemia. Additional exemplary myeloid disorders include, but are not limited to, acute promyeloid leukemia (APML), acute myelogenous leukemia (AML) and chronic myelogenous leukemia (CML) (reviewed in Vaickus (1991), *Crit Rev. Oncol./Hemotol.* 11:267-97); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas include, but are not limited to non-Hodgkin lymphoma and variants thereof, peripheral T cell lymphomas, adult T cell leukemia/lymphoma (ATL), cutaneous T-cell lymphoma (CTCL), large granular lymphocytic leukemia (LGF), Hodgkin's disease and Reed-Sternberg disease.

Examples of cellular proliferative and/or differentiative disorders of the breast include, but are not limited to, proliferative breast disease including, e.g., epithelial hyperplasia, sclerosing adenosis, and small duct papillomas; tumors, e.g., stromal tumors such as fibroadenoma, phyllodes tumor, and sarcomas, and epithelial tumors such as large duct papilloma; carcinoma of the breast including in situ (noninvasive) carcinoma that includes ductal carcinoma in situ (including Paget's disease) and lobular carcinoma in situ, and invasive (infiltrating) carcinoma including, but not limited to, invasive ductal carcinoma, invasive lobular carcinoma, medullary carcinoma, colloid (mucinous) carcinoma, tubular carcinoma, and invasive papillary carcinoma, and miscellaneous malignant neoplasms. Disorders in the male breast include, but are not limited to, gynecomastia and carcinoma.

Examples of cellular proliferative and/or differentiative disorders of the skin include, but are not limited to proliferative skin disease such as melanomas, including mucosal melanoma, superficial spreading melanoma, nodular melanoma, lentigo (e.g. lentigo maligna, lentigo maligna melanoma, or acral lentiginous melanoma), amelanotic melanoma, desmoplastic melanoma, melanoma with features of a Spitz nevus, melanoma with small nevus-like cells, polypoid melanoma, and soft-tissue melanoma; basal cell carcinomas including micronodular basal cell carcinoma, superficial basal cell carcinoma, nodular basal cell carcinoma (rodent ulcer), cystic basal cell carcinoma, cicatricial basal cell carcinoma, pigmented basal cell carcinoma, aberrant basal cell carcinoma, infiltrative basal cell carcinoma, nevoid basal cell carcinoma syndrome, polypoid basal cell carcinoma, pore-like basal cell carcinoma, and fibroepithelioma of Pinkus; squamus cell carcinomas including acanthoma (large cell acanthoma), adenoid squamous cell carcinoma, basaloid squamous cell carcinoma, clear cell squamous cell carcinoma, signet-ring cell squamous cell carcinoma, spindle cell squamous cell carcinoma, Marjolin's ulcer, erythroplasia of Queyrat, and Bowen's disease; or other skin or subcutaneous tumors.

Examples of cellular proliferative and/or differentiative disorders of the lung include, but are not limited to, bronchogenic carcinoma, including paraneoplastic syndromes, bronchioloalveolar carcinoma, neuroendocrine tumors, such as bronchial carcinoid, miscellaneous tumors, and metastatic tumors; pathologies of the pleura, including inflammatory pleural effusions, noninflammatory pleural effusions, pneumothorax, and pleural tumors, including solitary fibrous tumors (pleural fibroma) and malignant mesothelioma.

Examples of cellular proliferative and/or differentiative disorders of the colon include, but are not limited to, non-neoplastic polyps, adenomas, familial syndromes, colorectal carcinogenesis, colorectal carcinoma, and carcinoid tumors.

Examples of cellular proliferative and/or differentiative disorders of the liver include, but are not limited to, nodular hyperplasias, adenomas, and malignant tumors, including primary carcinoma of the liver and metastatic tumors. Examples of cellular proliferative and/or differentiative disorders of the ovary include, but are not limited to, ovarian tumors such as, tumors of coelomic epithelium, serous tumors, mucinous tumors, endometrioid tumors, clear cell adenocarcinoma, cystadenofibroma, Brenner tumor, surface epithelial tumors; germ cell tumors such as mature (benign) teratomas, monodermal teratomas, immature malignant teratomas, dysgerminoma, endodermal sinus tumor, choriocarcinoma; sex cord-stomal tumors such as, granulosa-theca cell tumors, thecomafibromas, androblastomas, hill cell tumors, and gonadoblastoma; and metastatic tumors such as Krukenberg tumors.

In one aspect, the present invention provides novel peptidomimetic macrocycles that are useful in competitive binding assays to identify agents which bind to the natural ligand(s) of the proteins or peptides upon which the peptidomimetic macrocycles are modeled. For example, in the BH3/BCL-XL anti-apoptotic system labeled peptidomimetic macrocycles based on BH3 can be used in a BCL-XL binding assay along with small molecules that competitively bind to BCL-XL. Competitive binding studies allow for rapid in vitro evaluation and determination of drug candidates specific for the BH3/BCL-XL system. The invention further provides for the generation of antibodies against the peptidomimetic macrocycles. In some embodiments, these antibodies specifically bind both the peptidomimetic macrocycle and the BH3 peptidomimetic precursors upon which the peptidomimetic macrocycles are derived. Such antibodies, for example, disrupt the BH3/BCL-XL systems, respectively.

In other aspects, the present invention provides for both prophylactic and therapeutic methods of treating a subject at risk of (or susceptible to) a disorder or having a disorder associated with aberrant (e.g., insufficient or excessive) BCL-2 family member expression or activity (e.g., extrinsic or intrinsic apoptotic pathway abnormalities). It is believed that some BCL-2 type disorders are caused, at least in part, by an abnormal level of one or more BCL-2 family members (e.g., over or under expression), or by the presence of one or more BCL-2 family members exhibiting abnormal activity. As such, the reduction in the level and/or activity of the BCL-2 family member or the enhancement of the level and/or activity of the BCL-2 family member, is used, for example, to ameliorate or reduce the adverse symptoms of the disorder.

In one embodiment, the compounds of the invention are used to treat disorders associated with expression or overexpression of Mcl-1. Mcl-1 has been shown to be expressed in many tissues and neoplastic cell lines and is thought to participate in the development of malignancies (Thallinger et al. (2004) Clin. Cancer Res. 10:4185-4191). The peptidomimetic macrocycles of the invention can be used for the treatment of such malignancies.

In one embodiment, the disorder being treated (e.g. cancer) is differentially responsive to the peptidomimetic macrocycles of the invention. In some embodiments, the cancer is treated with a BIM peptidomimetic macrocycle and is at least 2-fold less sensitive to treatment using a BID polypeptide (such as a BID peptidomimetic macrocycle or uncrosslinked polypeptide) as measured in an in vitro cell viability assay. In other embodiments, the cancer is at least 5-fold less sensitive to treatment using a BID polypeptide as measured in an in vitro cell viability assay. In yet other embodiments, the cancer is at least 8-fold less sensitive to treatment using a BID polypeptide as measured in an in vitro cell viability assay. In other embodiments, the cancer is treated with a BID peptidomimetic macrocycle and is at least 2-fold less sensitive to treatment using a BIM polypeptide (such as a BIM peptidomimetic macrocycle or uncrosslinked polypeptide) as measured in an in vitro cell viability assay. In other embodiments, the cancer is at least 5-fold less sensitive to treatment using a BIM polypeptide as measured in an in vitro cell viability assay. In yet other embodiments, the cancer is at least 8-fold less sensitive to treatment using a BIM polypeptide as measured in an in vitro cell viability assay.

In another embodiment, a method of treating a human patient is provided comprising performing an assay to evaluate the levels of a BCL-family protein and administering to the patient a peptidomimetic macrocycle if an aberrant or irregular level of expression of the BCL-family protein is detected. BCL-family proteins include, for example, BCL-2, BCL-XL, MCL-1, Bfl1/A1, BOO/DIVA, NRH/NR13, BAX, BAD, BAK, BOK, BIK, PUMA, BIM, BMF, BLK, BNIP3, HRK, NIX, SPIKE, and Noxa. In one embodiment, a method of treating a human patient is provided comprising performing an assay to evaluate the levels of BCL-2 in the patient and administering to the patient a peptidomimetic macrocycle if an aberrant or irregular level of expression of BCL-2 is detected. In another embodiment, a method of treating a human patient is provided comprising performing an assay to evaluate the levels of BCL-XL in the patient and administering to the patient a peptidomimetic macrocycle if an aberrant or irregular level of expression of BCL-XL is detected. In another embodiment, a method of treating a human patient is provided comprising performing an assay to evaluate the levels of MCL-1 in the patient and administering to the patient a peptidomimetic macrocycle if an aberrant or irregular level of expression of MCL-1 is detected. In another embodiment, a method of treating a human patient is provided comprising performing an assay to evaluate the levels of BAX in the patient and administering to the patient a peptidomimetic macrocycle if an aberrant or irregular level of expression of BAX is detected. In another embodiment, a method of treating a human patient is provided comprising performing an assay to evaluate the levels of BAD in the patient and administering to the patient a peptidomimetic macrocycle if an aberrant or irregular level of expression of BAD is detected. In another embodiment, a method of treating a human patient is provided comprising performing an assay to evaluate the levels of BAK in the patient and administering to the patient a peptidomimetic macrocycle if an aberrant or irregular level of expression of BAK is detected. In another embodiment, a method of treating a human patient is provided comprising performing an assay to evaluate the levels of PUMA in the patient and administering to the patient a peptidomimetic macrocycle if an aberrant or irregular level of expression of PUMA is detected. In another embodiment, a method of treating a human patient is provided comprising performing an assay to evaluate the levels of Noxa in the patient and administering to the patient a peptidomimetic macrocycle if an aberrant or irregular level of expression of Noxa is detected. In another embodiment, a method of treating a human patient is provided comprising performing an assay to evaluate the levels of Noxa in the patient and administering to the patient a peptidomimetic macrocycle if an aberrant or irregular level of expression of Noxa is detected. In another embodiment, a method of treating a human patient is provided comprising performing an assay to evaluate the levels of Bfl1/A1 in the patient and administering to the patient a peptidomimetic macrocycle if an aberrant or irregular level of expression of Bfl1/A1 is detected. In another embodiment, a method of treating a human patient is provided comprising performing an assay to evaluate the levels of BOO/DIVA in the patient and administering to the patient a peptidomimetic macrocycle if an aberrant or irregular level of expression of BOO/DIVA is detected. In another embodiment, a method of treating a human patient is provided comprising performing an assay to evaluate the levels of NRH/NR13 in the patient and administering to the patient a peptidomimetic macrocycle if an aberrant or irregular level of expression of NRH/NR13 is detected. In another embodiment, a method of treating a human patient is provided comprising performing an assay to evaluate the levels of BOK in the patient and administering to the patient a peptidomimetic macrocycle if an aberrant or irregular level of expression of BOK is detected. In another embodiment, a method of treating a human patient is provided comprising performing an assay to evaluate the levels of BIK in the patient and administering to the patient a peptidomimetic macrocycle if an aberrant or irregular level of expression of BIK is detected. In another embodiment, a method of treating a human patient is provided comprising performing an assay to evaluate the levels of BMF in the patient and administering to the patient a peptidomimetic macrocycle if an aberrant or irregular level of expression of BMF is detected. In another embodiment, a method of treating a human patient is provided comprising performing an assay to evaluate the levels of BLK in the patient and administering to the patient a peptidomimetic macrocycle if an aberrant or irregular level of expression of BLK is detected. In another embodiment, a method of treating a human patient is provided comprising performing an assay to evaluate the levels of BNIP3 in the patient and administering to the patient a peptidomimetic macrocycle if an aberrant or irregular level of expression of BNIP3 is detected. In another embodiment, a method of treating a human patient is provided comprising performing an assay to evaluate the levels of HRK in the patient and administering to the patient a peptidomimetic macrocycle if an aberrant or irregular level of expression of HRK is detected.

In another embodiment, a method of treating a human patient is provided comprising performing an assay to evaluate the levels of Nix in the patient and administering to the patient a peptidomimetic macrocycle if an aberrant or irregular level of expression of Nix is detected. In another embodiment, a method of treating a human patient is provided comprising performing an assay to evaluate the levels of SPIKE in the patient and administering to the patient a peptidomimetic macrocycle if an aberrant or irregular level of expression of SPIKE is detected.

In one aspect, the invention provides methods of treating breast cancer by administering the peptidomimetic macrocycles of the invention. Breast cancer includes invasive breast carcinomas, such as invasive ductal carcinoma, invasive lobular carcinoma, tubular carcinoma, invasive cribriform carcinoma, medullary carcinoma, mucinous carcinoma and other tumours with abundant mucin, cystadenocarcinoma, columnar cell mucinous carcinoma, signet ring cell carcinoma, neuroendocrine tumours (including solid neuroendocrine carcinoma, atypical carcinoid tumour, small cell/oat cell carcinoma, or large cell neuroendocrine carcioma), invasive papillary carcinoma, invasive micropapillary carcinoma, apocrine carcinoma, metaplastic carcinomas, pure epithelial metaplastic carciomas, mixed epithelial/mesenchymal metaplastic carcinomas, lipid-rich carcinoma, secretory carcinoma, oncocytic carcinoma, adenoid cystic carcinoma, acinic cell carcinoma, glycogen-rich clear cell carcinoma, sebaceous carcinoma, inflammatory carcinoma or bilateral breast carcinoma; mesenchymal tumors such as haemangioma, angiomatosis, haemangiopericytoma, pseudoangiomatous stromal hyperplasia, myofibroblastoma, fibromatosis (aggressive), inflammatory myofibroblastic tumour, lipoma, angiolipoma, granular cell tumour, neurofibroma, schwannoma, angiosarcoma, liposarcoma, rhabdomyosarcoma, osteosarcoma, leiomyoma, or leiomysarcoma; myoepithelial lesions such as myoepitheliosis, adenomyoepithelial adenosis, adenomyoepithelioma, or malignant myoepithelioma; fibroepithelial tumours such as fibroadenoma, phyllodes tumour, low grade periductal stromal sarcoma, or mammary hamartoma; and tumours of the nipple such as nipple adenoma, syringomatous adenoma, or Paget's disease of the nipple.

Treatment of breast cancer can be effected in conjunction with any additional therapy, such as a therapy that is part of the standard of care. A surgical technique such as lumpectomy or mastectomy can be performed prior to, during, or following treatment with the peptidomimetic macrocycles of the invention. Alternatively, radiation therapy can be used for the treatment of breast cancer in conjunction with the peptidomimetic macrocycles of the invention. In other cases, the peptidomimetic macrocycles of the invention are administered in combination with a second therapeutic agent. Such an agent can be a chemotherapeutic agent such as an individual drug or combination of drugs and therapies. For example, the chemotherapeutic agent can be an adjuvant chemotherapeutic treatment such as CMF (cyclophosphamide, methotrexate, and 5-fluorouracil); FAC or CAF (5-fluorouracil, doxorubicin, cyclophosphamide); AC or CA (doxorubicin and cyclophosphamide); AC-Taxol (AC followed by paclitaxel); TAC (docetaxel, doxorubicin, and cyclophosphamide); FEC (5-fluorouracil, epirubicin and cyclophosphamide); FECD (FEC followed by docetaxel); TC (docetaxel and cyclophosphamide). In addition to chemotherapy, trastuzumab can also be added to the regimen depending on the tumor characteristics (i.e. $HER_2$/neu status) and risk of relapse. Hormonal therapy can also be appropriate before, during or following chemotherapeutic treatment. For example, tamoxifen can be administered or a compound in the category of aromatase inhibitors including, but not limited to aminogluthetimide, anastrozole, exemestane, formestane, letrozole, or vorozole. In other embodiments, an antiangiogenic agent can be used in combination therapy for the treatment of breast cancer. The antiangiogenic agent can be an anti-VEGF agent including, but not limited to bevacizumab.

In another aspect, the peptidomimetic macrocycles of the invention can be used to treat ovarian cancer. Ovarian cancers include ovarian tumors such as, tumors of coelomic epithelium, serous tumors, mucinous tumors, endometrioid tumors, clear cell adenocarcinoma, cystadenofibroma, Brenner tumor, surface epithelial tumors; germ cell tumors such as mature (benign) teratomas, monodermal teratomas, immature malignant teratomas, dysgerminoma, endodermal sinus tumor, choriocarcinoma; sex cord-stomal tumors such as, granulosa-theca cell tumors, thecomafibromas, androblastomas, hill cell tumors, and gonadoblastoma; and metastatic tumors such as Krukenberg tumors.

The peptidomimetic macrocycles of the invention can be administered in conjunction with a second therapy such as a therapy that is part of the standard of care. Surgery, immunotherapy, chemotherapy, hormone therapy, radiation therapy, or a combination thereof, are some possible treatments available for ovarian cancer. Some possible surgical procedures include debulking, and a unilateral or bilateral oophorectomy and/or a unilateral or bilateral salpigectomy. Anti-cancer drugs that can be used include cyclophosphamide, etoposide, altretamine, and ifosfamide. Hormone therapy with the drug tamoxifen can be used to shrink ovarian tumors. Radiation therapy can be external beam radiation therapy and/or brachytherapy.

In another aspect, the peptidomimetic macrocycles of the invention can be used to treat prostate cancer. Prostate cancers include adenocarcinomas and metastasized adenocarcinomas. The peptidomimetic macrocycles of the invention can be administered in conjunction with a second therapy such as a therapy that is part of the standard of care. Treatment for prostate cancer can involve surgery, radiation therapy, High Intensity Focused Ultrasound (HIFU), chemotherapy, cryosurgery, hormonal therapy, or any combination thereof. Surgery can involve prostatectomy, radical perineal prostatectomy, laparoscopic radical prostatectomy, transurethral resection of the prostate or orchiectomy. Radiation therapy can include external beam radiation therapy and/or brachytherapy. Hormonal therapy can include orchiectomy; administration of antiandrogens such as flutamide, bicalutamide, nilutamide, or cyproterone acetate; medications which inhibit the production of adrenal androgens such as DHEA, such as ketoconazole and aminoglutethimide; and GnRH antagonists or agonists such as Abarelix (Plenaxis®), Cetrorelix (Cetrotide®), Ganirelix (Antagon®), leuprolide, goserelin, triptorelin, or buserelin. Treatment with an anti-androgen agent, which blocks androgen activity in the body, is another available therapy. Such agents include flutamide, bicalutamide, and nilutamide. This therapy is typically combined with LHRH analog administration or an orchiectomy, which is termed a combined androgen blockade (CAB). Chemotherapy includes, but is not limited to, administration of docetaxel, for example with a corticosteroid such as prednisone. Anti-cancer drugs such as doxorubicin, estramustine, etoposide, mitoxantrone, vinblastine, paclitaxel, carboplatin can also be administered to slow the growth of prostate cancer, reduce symptoms and improve the quality of life. Additional compounds such as bisphosphonate drugs can also be administered.

In another aspect, the peptidomimetic macrocycles of the invention can be used to treat renal cancer. Renal cancers include, but are not limited to, renal cell carcinomas, metastases from extra-renal primary neoplasms, renal lymphomas, squamous cell carcinomas, juxtaglomerular tumors (reninomas), transitional cell carcinomas, angiomyolipomas, oncocytomas and Wilm's tumors. The peptidomimetic macrocycles of the invention can be administered in conjunction with a second therapy such as a therapy that is part of the standard of care. Treatment for renal cancer can involve surgery, percutaneous therapies, radiation therapies, chemotherapy, vaccines, or other medication. Surgical techniques useful for treatment of renal cancer in combination with the peptidomimetic macrocycles of the invention include nephrectomy, which can include removal of the adrenal gland, retroperitoneal lymph nodes, and any other surrounding tissues affected by the invasion of the tumor. Percutaneous therapies include, for example, image-guided therapies which can involve imaging of a tumor followed by its targeted destruction by radiofrequency ablation or cryotherapy. In some cases, other chemotherapeutic or other medications useful in treating renal cancer can be α-interferon, interleukin-2, bevacizumab, sorafenib, sunitib, temsirolimus or other kinase inhibitors.

In other aspects, the invention provides methods of treating pancreatic cancer by administering peptidomimetic macrocycles of the invention, such as a pancreatic cancer selected from the following: an epitheliod carcinoma in the pancreatic duct tissue and an adenocarcinoma in a pancreatic duct. The most common type of pancreatic cancer is an adenocarcinoma, which occurs in the lining of the pancreatic duct. Possible treatments available for pancreatic cancer include surgery, immunotherapy, radiation therapy, and chemotherapy. Possible surgical treatment options include a distal or total pancreatectomy and a pancreaticoduodenectomy (Whipple procedure). Radiation therapy can be an option for pancreatic cancer patients, specifically external beam radiation where radiation is focused on the tumor by a machine outside the body. Another option is intraoperative electron beam radiation administered during an operation. Chemotherapy can also be used to treat pancreatic cancer patients. Suitable anti-cancer drugs include, but are not limited to, 5-fluorouracil (5-FU), mitomycin, ifosfamide, doxorubicin, streptozocin, chlorozotocin, and combinations thereof. The methods provided by the invention can provide a beneficial effect for pancreatic cancer patients, by administration of a polypeptide of the invention or a combination of administration of a peptidomimetic macrocycle and surgery, radiation therapy, or chemotherapy.

In one aspect, peptidomimetic macrocycles of the invention can be used for the treatment of colon cancer, including but not limited to non-neoplastic polyps, adenomas, familial syndromes, colorectal carcinogenesis, colorectal carcinoma, and carcinoid tumors. Possible treatments available for colon cancer that can be used in conjunction with the peptidomimetic macrocycles of the invention include surgery, chemotherapy, radiation therapy or targeted drug therapy.

Radiation therapy can include external beam radiation therapy and/or brachytherapy. Chemotherapy can be used to reduce the likelihood of metastasis developing, shrink tumor size, or slow tumor growth. Chemotherapy is often applied after surgery (adjuvant), before surgery (neo-adjuvant), or as the primary therapy if surgery is not indicated (palliative). For example, exemplary regimens for adjuvant chemotherapy involve the combination of infusional 5-fluorouracil, leucovorin, and oxaliplatin (FOLFOX). First line chemotherapy regimens can involve the combination of infusional 5-fluorouracil, leucovorin, and oxaliplatin (FOLFOX) with a targeted drug such as bevacizumab, cetuximab or panitumumab or infusional 5-fluorouracil, leucovorin, and irinotecan (FOLFIRI) with targeted drug such as bevacizumab, cetuximab or panitumumab. Other chemotherapeutic agents that can be useful in the treatment or prevention of colon cancer in combination with the peptidomimetic macrocycles of the invention are Bortezomib (Velcade®), Oblimersen (Genasense®, G3139), Gefitinib and Erlotinib (Tarceva®) and Topotecan (Hycamtin®).

Some embodiments provide methods for the treatment of lung cancer using the peptidomimetic macrocycles of the invention. Examples of cellular proliferative and/or differentiative disorders of the lung include, but are not limited to, bronchogenic carcinoma, including paraneoplastic syndromes, bronchioloalveolar carcinoma, neuroendocrine tumors, such as bronchial carcinoid, miscellaneous tumors, and metastatic tumors; pathologies of the pleura, including inflammatory pleural effusions, noninflammatory pleural effusions, pneumothorax, and pleural tumors, including solitary fibrous tumors (pleural fibroma) and malignant mesothelioma.

The most common type of lung cancer is non-small cell lung cancer (NSCLC), which accounts for approximately 80-85% of lung cancers and is divided into squamous cell carcinomas, adenocarcinomas, and large cell undifferentiated carcinomas. Small cell lung cancer, e.g. small cell lung carcinomas, accounts for 15-20% of lung cancers. Treatment options for lung cancer include surgery, immunotherapy, radiation therapy, chemotherapy, photodynamic therapy, or a combination thereof. Some possible surgical options for treatment of lung cancer are a segmental or wedge resection, a lobectomy, or a pneumonectomy. Radiation therapy can be external beam radiation therapy or brachytherapy. Some anti-cancer drugs that can be used in chemotherapy to treat lung cancer in combination with the peptidomimetic macrocycles of the invention include cisplatin, carboplatin, paclitaxel, docetaxel, gemcitabine, vinorelbine, irinotecan, etoposide, vinblastine, gefitinib, ifosfamide, methotrexate, or a combination thereof. Photodynamic therapy (PDT) can be used to treat lung cancer patients. The methods described herein can provide a beneficial effect for lung cancer patients, by administration of a peptidomimetic macrocycle or a combination of administration of a peptidomimetic macrocycle and surgery, radiation therapy, chemotherapy, photodynamic therapy, or a combination thereof.

Examples of cellular proliferative and/or differentiative disorders of the liver include, but are not limited to, nodular hyperplasias, adenomas, and malignant tumors, including primary carcinoma of the liver and metastatic tumors.

Immunoproliferative disorders (also known as "immunoproliferative diseases" or "immunoproliferative neoplasms") are disorders of the immune system that are characterized by the abnormal proliferation of the primary cells of the immune system, which includes B cells, T cells and Natural Killer (NK) cells, or by the excessive production of immunoglobulins (also known as antibodies). Such disorders include the general categories of lymphoproliferative disorders, hypergammaglobulinemias, and paraproteinemias. Examples of such disorders include, but are not limited to, X-linked lymphoproliferative disorder, autosomal lymphoproliferative disorder, Hyper-IgM syndrome, heavy chain disease, and cryoglobulinemia. Other immunoproliferative disorders can be graft versus host disease (GVHD); psoriasis; immune disorders associated with graft transplantation rejection; T cell lymphoma; T cell acute lymphoblastic leukemia; testicular angiocentric T cell lymphoma; benign lymphocytic angiitis; and autoimmune diseases such as lupus erythematosus, Hashimoto's thyroiditis, primary myxedema, Graves' disease, pernicious anemia, autoimmune atrophic gastritis, Addison's disease, insulin dependent diabetes mellitis, good pasture's syndrome, myasthenia gravis, pemphigus, Crohn's disease, sympathetic ophthalmia, autoimmune uveitis, multiple sclerosis, autoimmune hemolytic anemia, idiopathic thrombocytopenia, primary biliary cirrhosis, chronic action hepatitis, ulceratis colitis, Sjogren's syndrome, rheumatoid arthritis, polymyositis, scleroderma, and mixed connective tissue disease.

Combination Treatments

In one embodiment, peptidomimetic macrocycles of the invention can be used for the treatment of cancer in conjunction with alkylating and alkylating-like agents. Such agents include, for example, nitrogen mustards such as chlorambucil, chlormethine, cyclophosphamide, ifosfamide, and melphalan; nitrosoureas such as carmustine, fotemustine, lomustine, and streptozocin; platinum therapeutic agents such as carboplatin, cisplatin, oxaliplatin, BBR3464, and satraplatin; or other agents, including but not limited to busulfan, dacarbazine, procarbazine, temozolomide, thiotepa, treosulfan, or uramustine.

In another embodiment, peptidomimetic macrocycles of the invention can be used in conjunction with an antineoplastic agent which is an antimetabolite. For example, such an antineoplastic agent can be a folic acid such as aminopterin, methotrexate, pemetrexed, or raltitrexed. Alternatively, the antineoplastic agent can be a purine, including but not limited to cladribine, clofarabine, fludarabine, mercaptopurine, pentostatin, thioguanine. In further embodiments, the antineoplastic agent can be a pyrimidine such as capecitabine, cytarabine, fluorouracil, floxuridine, and gemcitabine.

In still other embodiments, peptidomimetic macrocycles of the invention can be used in conjunction with an antineoplastic agent which is an spindle poison/mitotic inhibitor. Agents in this category include taxanes, for example docetaxel and paclitaxel; and *vinca* alkaloids such as vinblastine, vincristine, vindesine, and vinorelbine. In yet other embodiments, peptidomimetic macrocycles of the invention can be used in combination with an antineoplastic agent which is a cytotoxic/antitumor antibiotic from the anthracycline family such as daunorubicin, doxorubicin, epirubicin, idarubicin, mitoxantrone, pixantrone, or valrubicin; an antibiotic from the streptomyces family such as actinomycin, bleomycin, mitomycin, or plicamycin; or hydroxyurea. Alternatively, agents used for combination therapy can be topoisomerase inhibitors including, but not limited to camptothecin, topotecan, irinotecan, etoposide, or teniposide.

Alternatively, the antineoplastic agent can be an antibody or antibody-derived agent. For example, a receptor tyrosine kinase-targeted antibody such as cetuximab, panitumumab, or trastuzumab can be used. Alternatively, the antibody can be an anti-CD20 antibody such as rituximab or tositumomab, or any other suitable antibody including but not limited to alemtuzumab, bevacizumab, and gemtuzumab. In other embodiments, the antineoplastic agent is a photosensitizer such as aminolevulinic acid, methyl aminolevulinate, porfimer sodium, or verteporfin. In still other embodiments, the antineoplastic agent is a tyrosine kinase inhibitor such as dediranib, dasatinib, erlotinib, gefitinib, imatinib, lapatinib, nilotinib, sorafenib, sunitinib, or vandetanib. Other neoplastic agents suitable in the use of the invention include, for example, alitretinoin, tretinoin, altretamine, amsacrine, anagrelide, arsenic trioxide, asparaginase (pegaspargase), bexarotene, bortezomib, denileukin diftitox, estramustine, ixabepilone, masoprocol, or mitotane.

In other or further embodiments, the peptidomimetics macrocycles described herein are used to treat, prevent or diagnose conditions characterized by overactive cell death or cellular death due to physiologic insult, etc. Some examples of conditions characterized by premature or unwanted cell death are or alternatively unwanted or excessive cellular proliferation include, but are not limited to hypocellular/hypoplastic, acellular/aplastic, or hypercellular/hyperplastic conditions. Some examples include hematologic disorders including but not limited to fanconi anemia, aplastic anemia, thalaessemia, congenital neutropenia, myelodysplasia In other or further embodiments, the peptidomimetics macrocycles of the invention that act to decrease apoptosis are used to treat disorders associated with an undesirable level of cell death. Thus, in some embodiments, the anti-apoptotic peptidomimetics macrocycles of the invention are used to treat disorders such as those that lead to cell death associated with viral infection, e.g., infection associated with infection with human immunodeficiency virus (HIV). A wide variety of neurological diseases are characterized by the gradual loss of specific sets of neurons, and the anti-apoptotic peptidomimetics macrocycles of the invention are used, in some embodiments, in the treatment of these disorders. Such disorders include Alzheimer's disease, Parkinson's disease, amyotrophic lateral sclerosis (ALS) retinitis pigmentosa, spinal muscular atrophy, and various forms of cerebellar degeneration. The cell loss in these diseases does not induce an inflammatory response, and apoptosis appears to be the mechanism of cell death. In addition, a number of hematologic diseases are associated with a decreased production of blood cells. These disorders include anemia associated with chronic disease, aplastic anemia, chronic neutropenia, and the myelodysplastic syndromes. Disorders of blood cell production, such as myelodysplastic syndrome and some forms of aplastic anemia, are associated with increased apoptotic cell death within the bone marrow. These disorders could result from the activation of genes that promote apoptosis, acquired deficiencies in stromal cells or hematopoietic survival factors, or the direct effects of toxins and mediators of immune responses. Two common disorders associated with cell death are myocardial infarctions and stroke. In both disorders, cells within the central area of ischemia, which is produced in the event of acute loss of blood flow, appear to die rapidly as a result of necrosis. However, outside the central ischemic zone, cells die over a more protracted time period and morphologically appear to die by apoptosis.

In other or further embodiments, the anti-apoptotic peptidomimetics macrocycles of the invention are used to treat all such disorders associated with undesirable cell death.

Some examples of immunologic disorders that are treated with the peptidomimetics macrocycles described herein include but are not limited to organ transplant rejection, arthritis, lupus, IBD, Crohn's disease, asthma, multiple sclerosis, diabetes, etc.

Some examples of neurologic disorders that are treated with the peptidomimetics macrocycles described herein include but are not limited to Alzheimer's Disease, Down's Syndrome, Dutch Type Hereditary Cerebral Hemorrhage Amyloidosis, Reactive Amyloidosis, Familial Amyloid Nephropathy with Urticaria and Deafness, Muckle-Wells Syndrome, Idiopathic Myeloma; Macroglobulinemia-Associated Myeloma, Familial Amyloid Polyneuropathy, Familial Amyloid Cardiomyopathy, Isolated Cardiac Amyloid, Systemic Senile Amyloidosis, Adult Onset Diabetes, Insulinoma, Isolated Atrial Amyloid, Medullary Carcinoma of the Thyroid, Familial Amyloidosis, Hereditary Cerebral Hemorrhage With Amyloidosis, Familial Amyloidotic Polyneuropathy, Scrapie, Creutzfeldt-Jacob Disease, Gerstmann Straussler-Scheinker Syndrome, Bovine Spongiform Encephalitis, a prion-mediated disease, and Huntington's Disease.

Some examples of endocrinologic disorders that are treated with the peptidomimetics macrocycles described herein include but are not limited to diabetes, hypothyroidism, hypopituitarism, hypoparathyroidism, hypogonadism, etc.

Examples of cardiovascular disorders (e.g., inflammatory disorders) that are treated or prevented with the peptidomimetics macrocycles of the invention include, but are not limited to, atherosclerosis, myocardial infarction, stroke, thrombosis, aneurism, heart failure, ischemic heart disease, angina pectoris, sudden cardiac death, hypertensive heart disease; non-coronary vessel disease, such as arteriolosclerosis, small vessel disease, nephropathy, hypertriglyceridemia, hypercholesterolemia, hyperlipidemia, xanthomatosis, asthma, hypertension, emphysema and chronic pulmonary disease; or a cardiovascular condition associated with interventional procedures ("procedural vascular trauma"), such as restenosis following angioplasty, placement of a shunt, stent, synthetic or natural excision grafts, indwelling catheter, valve or other implantable devices. Preferred cardiovascular disorders include atherosclerosis, myocardial infarction, aneurism, and stroke.

In some embodiments, the peptidomimetic macrocycles are useful in the treatment of viral disorders. For example, in the PB1/PA system, labeled peptidomimetic macrocycles based on PB1 can be used in a PA binding assay along with small molecules that competitively bind to PA. Competitive binding studies allow for rapid in vitro evaluation and determination of drug candidates specific for the PB1/PA system. Such binding studies can be performed with any of the peptidomimetic macrocycles disclosed herein and their binding partners. Antibodies can also be developed which disrupt the binding between PA and PD1.

For example, peptidomimetic macrocycles derived from the PB1 helix sequence, or peptidomimetic macrocycles that bind selectively to the PB1 peptide binding site of the PA protein, can selectively inhibit influenza RNA-dependent RNA polymerases. Peptidomimetic macrocycles derived from the PB2 helix sequence, or peptidomimetic macrocycles that bind selectively to the PB2 peptide binding site of the PB1 protein, can selectively inhibit influenza RNA-dependent RNA polymerases. When administered within a therapeutic window after infection, such peptidomimetic macrocycles can reduce the severity or duration of an influenza infection. When administered prophylactically, such peptidomimetic macrocycles can prevent infection by influenza viruses and thereby decrease the spread of influenza and reduce large-scale epidemics.

In one aspect, the present invention provides novel peptidomimetic macrocycles that are useful in competitive binding assays to identify agents which bind to the natural ligand(s) of the proteins or peptides upon which the peptidomimetic macrocycles are modeled. For example, in the PB1/PA system, labeled peptidomimetic macrocycles based on PB1 can be used in a PA binding assay along with small molecules that competitively bind to PA. Competitive binding studies allow for rapid in vitro evaluation and determination of drug candidates specific for the PB1/PA system. Such binding studies can be performed with any of the peptidomimetic macrocycles disclosed herein and their binding partners.

In other aspects, the present invention provides for both prophylactic and therapeutic methods of treating a subject infected with, at risk of, or susceptible to an influenza virus. These methods comprise administering an effective amount of a compound to a warm blooded animal, including a human. In some embodiments, the administration of the compounds of the present invention prevents the proliferation or transmission of an influenza virus.

In some embodiments, peptidomimetic macrocycles are used to treat diseases induced by influenza viruses. Like other viruses, the replication of influenza virus involves six phases; transmission, entry, replication, biosynthesis, assembly, and exit. Entry occurs by endocytosis, replication and vRNP assembly takes place in the nucleus, and the virus buds from the plasma membrane. In the infected patient, the virus targets airway epithelial cells.

The methods described herein are also useful for development and/or identification of agents for the treatment of infections caused by viruses such as Abelson leukemia virus, Abelson murine leukemia virus, Abelson's virus, Acute laryngotracheobronchitis virus, Adelaide River virus, Adeno associated virus group, Adenovirus, African horse sickness virus, African swine fever virus, AIDS virus, Aleutian mink disease parvovirus, Alpharetrovirus, Alphavirus, ALV related virus, Amapari virus, Aphthovirus, Aquareovirus, Arbovirus, Arbovirus C, arbovirus group A, arbovirus group B, Arenavirus group, Argentine hemorrhagic fever virus, Argentine hemorrhagic fever virus, Arterivirus, Astrovirus, Ateline herpesvirus group, Aujezky's disease virus, Aura virus, Ausduk disease virus, Australian bat lyssavirus, Aviadenovirus, avian erythroblastosis virus, avian infectious bronchitis virus, avian leukemia virus, avian leukosis virus, avian lymphomatosis virus, avian myeloblastosis virus, avian paramyxovirus, avian pneumoencephalitis virus, avian reticuloendotheliosis virus, avian sarcoma virus, avian type C retrovirus group, Avihepadnavirus, Avipoxvirus, B virus, B19 virus, Babanki virus, baboon herpesvirus, baculovirus, Barmah Forest virus, Bebaru virus, Berrimah virus, Betaretrovirus, Birnavirus, Bittner virus, BK virus, Black Creek Canal virus, bluetongue virus, Bolivian hemorrhagic fever virus, Boma disease virus, border disease of sheep virus, borna virus, bovine alphaherpesvirus 1, bovine alphaherpesvirus 2, bovine coronavirus, bovine ephemeral fever virus, bovine immunodeficiency virus, bovine leukemia virus, bovine leukosis virus, bovine mammillitis virus, bovine papillomavirus, bovine papular stomatitis virus, bovine parvovirus, bovine syncytial virus, bovine type C oncovirus, bovine viral diarrhea virus, Buggy Creek virus, bullet shaped virus group, Bunyamwera virus supergroup, Bunyavirus, Burkitt's lymphoma virus, Bwamba Fever, CA virus, Calicivirus, California encephalitis virus, camelpox virus, canarypox virus, canid herpesvirus, canine coronavirus, canine distemper virus, canine herpesvirus, canine minute virus, canine parvovirus, Cano Delgadito virus, caprine arthritis virus, caprine encephalitis virus, Caprine Herpes Virus, Capripox virus, Cardiovirus, caviid herpesvirus 1, Cercopithecid herpesvirus 1, cercopithecine herpesvirus 1, Cercopithecine herpesvirus 2, Chandipura virus, Changuinola virus, channel catfish virus, Charleville virus, chickenpox virus, Chikungunya virus, chimpanzee herpesvirus, chub reovirus, chum salmon virus, Cocal virus, Coho salmon reovirus, coital exanthema virus, Colorado tick fever virus, Coltivirus, Columbia SK virus, common cold virus, contagious ecthyma virus, contagious pustular dermatitis virus, Coronavirus, Corriparta virus, coryza virus, cowpox virus, coxsackie virus, CPV (cytoplasmic polyhedrosis virus), cricket paralysis virus, Crimean-Congo hemorrhagic fever virus, croup associated virus, Cryptovirus, Cypovirus, Cytomegalovirus, cytomegalovirus group, cytoplasmic polyhedrosis virus, deer papillomavirus, deltaretrovirus, dengue virus, Densovirus, Dependovirus, Dhori virus, diploma virus, *Drosophila* C virus, duck hepatitis B virus, duck hepatitis virus 1, duck hepatitis virus 2, duovirus, Duvenhage virus, Deformed wing virus DWV, eastern equine encephalitis virus, eastern equine encephalomyelitis virus, EB virus, Ebola virus, Ebola-like virus, echo virus, echovirus, echovirus 10, echovirus 28, echovirus 9, ectromelia virus, EEE virus, EIA virus, EIA virus, encephalitis virus, encephalomyocarditis group virus, encephalomyocarditis virus, Enterovirus, enzyme elevating virus, enzyme elevating virus (LDH), epidemic hemorrhagic fever virus, epizootic hemorrhagic disease virus, Epstein-Barr virus, equid alphaherpesvirus 1, equid alphaherpesvirus 4, equid herpesvirus 2, equine abortion virus, equine arteritis virus, equine encephalosis virus, equine infectious anemia virus, equine morbillivirus, equine rhinopneumonitis virus, equine rhinovirus, Eubenangu virus, European elk papillomavirus, European swine fever virus, Everglades virus, Eyach virus, felid herpesvirus 1, feline calicivirus, feline fibrosarcoma virus, feline herpesvirus, feline immunodeficiency virus, feline infectious peritonitis virus, feline leukemia/sarcoma virus, feline leukemia virus, feline panleukopenia virus, feline parvovirus, feline sarcoma virus, feline syncytial virus, Filovirus, Flanders virus, Flavivirus, foot and mouth disease virus, Fort Morgan virus, Four Corners hantavirus, fowl adenovirus 1, fowlpox virus, Friend virus, Gammaretrovirus, GB hepatitis virus, GB virus, German measles virus, Getah virus, gibbon ape leukemia virus, glandular fever virus, goatpox virus, golden shinner virus, Gonometa virus, goose parvovirus, granulosis virus, Gross' virus, ground squirrel hepatitis B virus, group A arbovirus, Guanarito virus, guinea pig cytomegalovirus, guinea pig type C virus, Hantaan virus, Hantavirus, hard clam reovirus, hare fibroma virus, HCMV (human cytomegalovirus), hemadsorption virus 2, hemagglutinating virus of Japan, hemorrhagic fever virus, hendra virus, Henipaviruses, Hepadnavirus, hepatitis A virus, hepatitis B virus group, hepatitis C virus, hepatitis D virus, hepatitis delta virus, hepatitis E virus, hepatitis F virus, hepatitis G virus, hepatitis nonA nonB virus, hepatitis virus, hepatitis virus (nonhuman), hepatoencephalomyelitis reovirus 3, Hepatovirus, heron hepatitis B virus, herpes B virus, herpes simplex virus, herpes simplex virus 1, herpes simplex virus 2, herpesvirus, herpesvirus 7, Herpesvirus ateles, Herpesvirus *hominis*, Herpesvirus infection, Herpesvirus saimiri, Herpesvirus suis, Herpesvirus varicellae, Highlands J virus, Hirame rhabdovirus, hog cholera virus, human adenovirus 2, human alphaherpesvirus 1, human alphaherpesvirus 2, human alphaherpesvirus 3; human B lymphotropic virus, human betaherpesvirus 5, human coronavirus, human cytomegalovirus group, human foamy virus, human gammaherpesvirus 4, human gammaherpesvirus 6, human hepatitis A virus, human herpesvirus 1 group, human herpesvirus 2 group, human herpesvirus 3 group, human herpesvirus 4 group, human herpesvirus 6, human herpesvirus 8, human immunodeficiency virus, human immunodeficiency virus 1, human immunodeficiency virus 2, human papillomavirus, human T cell leukemia virus, human T cell leukemia virus I, human T cell leukemia virus II, human T cell leukemia virus III, human T cell lymphoma virus I, human T cell lymphoma virus II, human T cell lymphotropic virus type 1, human T cell lymphotropic virus type 2, human T lymphotropic virus I, human T lymphotropic virus II, human T lymphotropic virus III, Ichnovirus, infantile gastroenteritis virus, infectious bovine rhinotracheitis virus, infectious haematopoietic necrosis virus, infectious pancreatic necrosis virus, influenza virus A, influenza virus B, influenza virus C, influenza virus D, influenza virus pr8, insect iridescent virus, insect virus, iridovirus, Japanese B virus, Japanese encephalitis virus, JC virus, Junin virus, Kaposi's sarcoma-associated herpesvirus, Kemerovo virus, Kilham's rat virus, Klamath virus, Kolongo virus, Korean hemorrhagic fever virus, kumba virus, Kysanur forest disease virus, Kyzylagach virus, La Crosse virus, lactic dehydrogenase elevating virus, lactic dehydrogenase virus, Lagos bat virus, Langur virus, lapine parvovirus, Lassa fever virus, Lassa virus, latent rat virus, LCM virus, Leaky virus, Lentivirus, Leporipoxvirus, leukemia virus, leukovirus, lumpy skin disease virus, lymphadenopathy associated virus, Lymphocryptovirus, lymphocytic choriomeningitis virus, lymphoproliferative virus group, Machupo virus, mad itch virus, mammalian type B oncovirus group, mammalian type B retroviruses, mammalian type C retrovirus group, mammalian type D retroviruses, mammary tumor virus, Mapuera virus, Marburg virus, Marburg-like virus, Mason Pfizer monkey virus, Mastadenovirus, Canaro virus, ME virus, measles virus, Menangle virus, Mengo virus, Mengovirus, Middelburg virus, milkers nodule virus, mink enteritis virus, minute virus of mice, MLV related virus, MM virus, Mokola virus, Molluscipoxvirus, Molluscum contagiosum virus, monkey B virus, monkeypox virus, Mononegavirales, Morbillivirus, Mount Elgon bat virus, mouse cytomegalovirus, mouse encephalomyelitis virus, mouse hepatitis virus, mouse K virus, mouse leukemia virus, mouse mammary tumor virus, mouse minute virus, mouse pneumonia virus, mouse poliomyelitis virus, mouse polyomavirus, mouse sarcoma virus, mousepox virus, Mozambique virus, Mucambo virus, mucosal disease virus, mumps virus, murid betaherpesvirus 1, murid cytomegalovir-s 2, murine cytomegalovirus group, murine encephalomyelitis virus, murine hepatitis virus, murine leukemia virus, murine nodule inducing virus, murine polyomavirus, murine sarcoma virus, Muromegalovirus, Murray Valley encephalitis virus, myxoma virus, Myxovirus, Myxovirus multiforme, Myxovirus parotitidis, Nairobi sheep disease virus, Nairovirus, Nanirnavirus, Nariva virus, Ndumo virus, Neethling virus, Nelson Bay virus, neurotropic virus, New World Arenavirus, newborn pneumonitis virus, Newcastle disease virus, Nipah virus, noncytopathogenic virus, Norwalk virus, nuclear polyhedrosis virus (NPV), nipple neck virus, O'nyong'nyong virus, Ockelbo virus, oncogenic virus, oncogenic viruslike particle, oncornavirus, Orbivirus, Orf virus, Oropouche virus, Orthohepadnavirus, Orthomyxovirus, Orthopoxvirus, Orthoreovirus, Orungo, ovine papillomavirus, ovine catarrhal fever virus, owl monkey herpesvirus, Palyam virus, Papillomavirus, Papillomavirus sylvilagi, Papovavirus, parainfluenza virus, parainfluenza virus type 1, parainfluenza virus type 2, parainfluenza virus type 3, parainfluenza virus type 4, Paramyxovirus, Parapoxvirus, paravaccinia virus, Parvovirus, Parvovirus B19, parvovirus group, Pestivirus, Phlebovirus, phocine distemper virus, Picodnavirus, Picornavirus, pig cytomegalovirus, pigeonpox virus, Piry virus, Pixuna virus, pneumonia virus of mice, Pneumovirus, poliomyelitis virus, poliovirus, Polydnavirus, polyhedral virus, polyoma virus, Polyomavirus, Polyomavirus *bovis*, Polyomavirus cercopitheci, Polyomavirus *hominis* 2, Polyomavirus maccacae 1, Polyomavirus *muris* 1, Polyomavirus *muris* 2, Polyomavirus papionis 1, Polyomavirus papionis 2, Polyomavirus sylvilagi, Pongine herpesvirus 1, porcine epidemic diarrhea virus, porcine hemagglutinating encephalomyelitis virus, porcine parvovirus, porcine transmissible gastroenteritis virus, porcine type C virus, pox virus, poxvirus, poxvirus variolae, Prospect Hill virus, Provirus, pseudocowpox virus, pseudorabies virus, psittacinepox virus, quailpox virus, rabbit fibroma virus, rabbit kidney vaculolating virus, rabbit papillomavirus, rabies virus, raccoon parvovirus, raccoonpox virus, Ranikhet virus, rat cytomegalovirus, rat parvovirus, rat virus, Rauscher's virus, recombinant vaccinia virus, recombinant virus, reovirus, reovirus 1, reovirus 2, reovirus 3, reptilian type C virus, respiratory infection virus, respiratory syncytial virus, respiratory virus, reticuloendotheliosis virus, Rhabdovirus, Rhabdovirus carpia, Rhadinovirus, Rhinovirus, Rhizidiovirus, Rift Valley fever virus, Riley's virus, rinderpest virus, RNA tumor virus, Ross River virus, Rotavirus, rougeole virus, Rous sarcoma virus, rubella virus, rubeola virus, Rubivirus, Russian autumn encephalitis virus, SA 11 simian virus, SA2 virus, Sabia virus, Sagiyama virus, Saimirine herpesvirus 1, salivary gland virus, sandfly fever virus group, Sandjimba virus, SARS virus, SDAV (sialodacryoadenitis virus), sealpox virus, Semliki Forest Virus, Seoul virus, sheeppox virus, Shope fibroma virus, Shope papilloma virus, simian foamy virus, simian hepatitis A virus, simian human immunodeficiency virus, simian immunodeficiency virus, simian parainfluenza virus, simian T cell lymphotrophic virus, simian virus, simian virus 40, Simplexvirus, Sin Nombre virus, Sindbis virus, smallpox virus, South American hemorrhagic fever viruses, sparrowpox virus, Spumavirus, squirrel fibroma virus, squirrel monkey retrovirus, SSV 1 virus group, STLV (simian T lymphotropic virus) type I, STLV (simian T lymphotropic virus) type II, STLV (simian T lymphotropic virus) type III, stomatitis papulosa virus, submaxillary virus, suid alphaherpesvirus 1, suid herpesvirus 2, Suipoxvirus, swamp fever virus, swinepox virus, Swiss mouse leukemia virus, TAC virus, Tacaribe complex virus, Tacaribe virus, Tanapox virus, Taterapox virus, Tench reovirus, Theiler's encephalomyelitis virus, Theiler's virus, Thogoto virus, Thottapalayam virus, Tick borne encephalitis virus, Tioman virus, Togavirus, Torovirus, tumor virus, Tupaia virus, turkey rhinotracheitis virus, turkeypox virus, type C retroviruses, type D oncovirus, type D retrovirus group, ulcerative disease rhabdovirus, Una virus, Uukuniemi virus group, vaccinia virus, vacuolating virus, varicella zoster virus, Varicellovirus, Varicola virus, variola major virus, variola virus, Vasin Gishu disease virus, VEE virus, Venezuelan equine encephalitis virus, Venezuelan equine encephalomyelitis virus, Venezuelan hemorrhagic fever virus, vesicular stomatitis virus, Vesiculovirus, Vilyuisk virus, viper retrovirus, viral haemorrhagic septicemia virus, Visna Maedi virus, Visna virus, volepox virus, VSV (vesicular stomatitis virus). Wallal virus, Warrego virus, wart virus, WEE virus, West Nile virus, western equine encephalitis virus, western equine encephalomyelitis virus, Whataroa virus, Winter Vomiting Virus, woodchuck hepatitis B virus, woolly monkey sarcoma virus, wound tumor virus, WRSV virus, Yaba monkey tumor virus, Yaba virus, Yatapoxvirus, yellow fever virus, and the Yug Bogdanovac virus. In one embodiment an infectome will be produced for each virus that includes an inventory of the host cellular genes involved in virus infection during a specific phase of viral infection, such cellular entry or the replication cycle.

For some viruses a great deal of progress has been made in the elucidation of the steps involved during infection of host cells, and any of these steps can be targeted using peptidomimetic macrocycles. For example, experiments initiated in the early 1980s showed that influenza virus follows a stepwise, endocytic entry program with elements shared with other viruses such as alpha- and rhabdoviruses (Marsh and Helenius 1989; Whittaker 2006). The steps include: 1) Initial attachment to sialic acid containing glycoconjugates receptors on the cell surface; 2) signaling induced by the virus particle; 3) endocytosis by clathrin-dependent and clathrin-independent cellular mechanism; 4) acid-induced, hemaglutinin (HA)-mediated penetration from late endosomes; 5) acid-activated, M2 and matrix protein (M1) dependent uncoating of the capsid; and, 6) intra-cytosolic transport and nuclear import of vRNPs. These steps depend on assistance from the host cell in the form of sorting receptors, vesicle formation machinery, kinase-mediated regulation, organelle acidification, and, most likely, activities of the cytoskeleton.

Influenza attachment to the cells surface occurs via binding of the HAI subunit to cell surface glycoproteins and glycolipids that carry oligosaccharide moieties with terminal sialic acid residues (Skehel and Wiley 2000). The linkage by which the sialic acid is connected to the next saccharide contributes to species specificity. Avian strains including H5N1 prefer an a-(2,3)-link and human strains a-(2,6)-link (Matrosovich 2006). In epithelial cells, binding occurs preferentially to microvilli on the apical surface, and endocytosis occurs at base of these extensions (Matlin 1982). Whether receptor binding induces signals that prepare the cell for the invasion is not yet known, but it is likely because activation of protein kinase C and synthesis of phopshatidylinositol-3-phosphate (PI3P) are required for efficient entry (Sieczkarski et al. 2003; Whittaker 2006).

Endocytic internalization occurs within a few minutes after binding (Matlin 1982; Yoshimura and Ohnishi 1984). In tissue culture cells influenza virus makes use of three different types of cellular processes; 1) preexisting clathrin coated pits, 2) virus-induced clathrin coated pits, and 3) endocytosis in vesicles without visible coat (Matlin 1982; Sieczkarski and Whittaker 2002; Rust et al. 2004). Video microscopy using fluorescent viruses showed the virus particles undergoing actin-mediated rapid motion in the cell periphery followed by minus end-directed, microtubule-mediated transport to the perinuclear area of the cell. Live cell imaging indicated that the virus particles first entered a subpopulation of mobile, peripheral early endosomes that carry them deeper into the cytoplasm before penetration takes place (Lakadamyali et al. 2003; Rust et al. 2004). The endocytotic process is regulated by protein and lipid kinases, the proteasome, as well as by Rabs and ubiquitin-dependent sorting factors (Khor et al. 2003; Whittaker 2006).

The membrane penetration step is mediated by low pH-mediated activation of the trimeric, metastable HA, and the conversion of this Type I viral fusion protein to a membrane fusion competent conformation (Maeda et al. 1981; White et al. 1982). This occurs about 16 min after internalization, and the pH threshold varies between strains in the 5.0-5.6 range. The target membrane is the limiting membrane of intermediate or late endosomes. The mechanism of fusion has been extensively studied (Kielian and Rey 2006). Further it was observed that fusion itself does not seem to require any host cell components except a lipid bilayer membrane and a functional acidification system (Maeda et al. 1981; White et al. 1982). The penetration step is inhibited by agents such as lysosomotropic weak bases, carboxylic ionophores, and proton pump inhibitors (Matlin 1982; Whittaker 2006).

To allow nuclear import of the incoming vRNPs, the capsid has to be disassembled. This step involves acidification of the viral interior through the amantadine-sensitive M2-channels causes dissociation of M1 from the vRNPs (Bukrinskaya et al. 1982; Martin and Helenius 1991; Pinto et al. 1992). Transport of the individual vRNPs to the nuclear pore complexes and transfer into the nucleus depends on cellular nuclear transport receptors (O'Neill et al. 1995; Cros et al. 2005). Replication of the viral RNAs (synthesis of positive and negative strands), and transcription occurs in complexes tightly associated with the chromatin in the nucleus. It is evident that, although many of the steps are catalyzed by the viral polymerase, cellular factors are involved including RNA polymerase activating factors, a chaperone HSP90, hCLE, and a human splicing factor UAP56. Viral gene expression is subject to complex cellular control at the transcriptional level, a control system dependent on cellular kinases (Whittaker 2006).

The final assembly of an influenza particle occurs during a budding process at the plasma membrane. In epithelial cells, budding occurs at the apical membrane domain only (Rodriguez-Boulan 1983). First, the progeny vRNPs are transported within the nucleoplasm to the nuclear envelope, then from the nucleus to the cytoplasm, and finally they accumulate in the cell periphery. Exit from the nucleus is dependent on viral protein NEP and M1, and a variety of cellular proteins including CRM1 (a nuclear export receptor), caspases, and possibly some nuclear protein chaperones. Phosphorylation plays a role in nuclear export by regulating M1 and NEP synthesis, and also through the MAPK/ERK system (Bui et al. 1996; Ludwig 2006). G protein and protein kinase signaling is involved in influenza virus budding from infected host cells (Hui E. and Nayak D, 2002).

The three membrane proteins of the virus are synthesized, folded and assembled into oligomers in the ER (Doms et al. 1993). They pass through the Golgi complex; undergo maturation through modification of their carbohydrate moieties and proteolytic cleavage. After reaching the plasma membrane they associate with M1 and the vRNPs in a budding process that result in the inclusion of all eight vRNPs and exclusion of most host cell components except lipids.

Influenza infection is associated with activation of several signaling cascades including the MAPK pathway (ERK, JNK, p38 and BMK-1/ERK5), the κB/NF-κB signaling module, the Raf/MEK/ERK cascade, and programmed cell death (Ludwig 2006). These result in a variety of effects that limit the progress of infection such as transcriptional activation of IFN-0, apoptotic cell death, and a block in virus escape of from late endosomes (Ludwig 2006).

Administration

The aqueous pharmaceutical formulations of the present disclosure can draw upon many suitable parenteral modes of administration route. The formulations can be, for example, administered intravenously, intraarterially, intrathecally, or subcutaneously. If combinations of agents are administered as separate formulations, they can be administered by the same route or by different routes.

In some embodiments, the aqueous pharmaceutical formulation is administered in a single dose. A single dose of the aqueous pharmaceutical formulation can also be used when it is co-administered with another substance (e.g., an analgesic) for treatment of an acute condition.

In some embodiments, the aqueous pharmaceutical formulation (by itself or in combination with other drugs) is administered in multiple doses. Dosing can be about once, twice, three times, four times, five times, six times, seven times, eight times, nine times, ten times or more than ten times per day. Dosing can be about once a year, twice a year, every six months, every 4 months, every 3 months, every 60 days, once a month, once every two weeks, once a week, or once every other day. In another embodiment the aqueous pharmaceutical formulation alone or in combination with another therapeutic substance is administered together about once per day to about 10 times per day. In another embodiment the administration of the aqueous pharmaceutical formulation alone or in combination with another therapeutic substance continues for less than about 7 days. In yet another embodiment the administration continues for more than about 6, 10, 14, 28 days, two months, six months, or one year.

Administration of the formulations of the disclosure can continue as long as necessary. In some embodiments, a aqueous pharmaceutical formulation of the disclosure is administered for more than 1, 2, 3, 4, 5, 6, 7, 14, 28, 35, 42, 49, 56, 63, 70, 77, 84, 91, 98, 105, 112, 119, 126, 133, or 140 days. In some embodiments, a aqueous pharmaceutical formulation of the disclosure is administered for less than 140, 133, 126, 119, 112, 105, 98, 91, 84, 77, 70, 63, 56, 49, 42, 35, 28, 14, 7, 6, 5, 4, 3, 2, or 1 day. In some embodiments, an aqueous pharmaceutical formulation of the disclosure is administered for more than 1, 2, 3, 4, 5, 6, 7, 8, 9, 10, 11, or 12 days. In some embodiments, a aqueous pharmaceutical formulation of the disclosure is administered for less than 12, 11, 10, 9, 8, 7, 6, 5, 4, 3, 2, or 1 months. In some embodiments, an aqueous pharmaceutical formulation of the disclosure is administered for more than 1, 2, 3, 4, 5, 6, 7, 8, 9, 10, 11, or 12 years. In some embodiments, a aqueous pharmaceutical formulation of the disclosure is administered for less than 12. 11, 10, 9, 8, 7, 6, 5, 4, 3, 2, or 1 years. In some embodiments, a aqueous pharmaceutical formulation of the disclosure is administered chronically on an ongoing basis.

Dosing for the aqueous pharmaceutical formulation formulations of the disclosure can be found by routine experimentation. The daily dose can range from about $1 \times 10^{-8}$ g to 5000 mg. Daily dose range can depend on the form of the aqueous pharmaceutical formulation e.g., the peptidomimetic macrocycle used, and/or route of administration, as described herein. For example, daily dose can be in the range of about 0.1-5000 mg, about 0.1-3000 mg, about 0.1-2000 mg, about 0.1-1000 mg, about 01.-500 mg, about 0.1-100 mg, 1-5000 mg, about 1-3000 mg, about 1-2000 mg, about 1-1000 mg, about 1-500 mg, or about 1-100 mg, about 10-5000 mg, about 10-3000 mg, about 10-2000 mg, about 10-1000 mg, about 10-500 mg, about 10-200 mg, about 10-100 mg, about 20-2000 mg, about 20-1500 mg, about 20-1000 mg, about 20-500 mg, about 20-100 mg, about 50-5000 mg, about 50-4000 mg, about 50-3000 mg, about 50-2000 mg, about 50-1000 mg, about 50-500 mg, about 50-100 mg, about 100-5000 mg, about 100-4000 mg, about 100-3000 mg, about 100-2000 mg, about 100-1000 mg, about 100-500 mg. In some embodiments, the daily dose of the aqueous pharmaceutical formulation is about 0.01, 0.1, 1, 10, 20, 30, 40, 50, 60, 70, 80, 90, 100, 200, 300, 400, 500, 600, 700, 800, 900, or 1000 mg. In some embodiments, the daily dose of the aqueous pharmaceutical formulation is 0.01 mg. In some embodiments, the daily dose of the aqueous pharmaceutical formulation is 0.1 mg. In some embodiments, the daily dose of the aqueous pharmaceutical formulation is 1 mg. In some embodiments, the daily dose of the aqueous pharmaceutical formulation is up to 10 mg. In some embodiments, the daily dose of the aqueous pharmaceutical formulation is up to 20 mg. In some embodiments, the daily dose of the aqueous pharmaceutical formulation is 50 mg. In some embodiments, the daily dose of the aqueous pharmaceutical formulation is 100 mg.

III. Kits

For use in the therapeutic methods of use described herein, the formulations of the disclosure can be available as a kit. Such kits can include a carrier, package, or container that is optionally compartmentalized to receive one or more doses of the aqueous pharmaceutical formulations for use in a method described herein. The kits provided herein can contain packaging materials. Packaging materials for use in packaging pharmaceutical products include, but are not limited to those described in e.g., U.S. Pat. No. 5,323,907. Examples of pharmaceutical packaging materials include, but are not limited to, blister packs, bottles, tubes, bags, containers, bottles, and any packaging material suitable for a selected formulation and intended mode of administration and treatment.

The aqueous pharmaceutical formulations of the disclosure can be packaged in multidose form or in single dose form. In some cases, the formulations are packaged in multidose forms. In some embodiments the formulations are packaged as single dose units. In some embodiments of the disclosure single dose packaging of the formulations can offer several advantages over multi dose packaging including dosage control, increased patient compliance, improved product labeling, and reduced counterfeiting. In various embodiments single dosage packaging of the formulations of the disclosure can be in form of vials, ampoules, tubes, bottles, pouches, packettes, syringes or blister packs. In some embodiments the single dose containers can be grouped together and placed into additional containers. In some embodiments the secondary container is a pouch.

In some examples, the formulations of the disclosure can be packed in a bottle or a vial. In some examples, the formulations can be packed in glass serum vial. In some examples, the formulations can be packed in serum vials composed of borosilicate glass. In some examples, the formulations are packed in a 1 mL, a 2 mL, a 3 mL, a 4 mL, a 5 mL, a 10 mL, a 20 mL, a 30 mL, or a 50 mL glass vial. In some examples, the formulations are packed in a 5 mL glass vial. In some examples, the formulations are packed in a 10 mL glass vial. In some examples, the formulations are packed in a 15 mL glass vial. In some examples, the formulations are packed in a 20 mL glass vial. In some embodiments, the vials comprise a 5 mm, a 10 mm, a 15 mm, 20 mm, 30 mm, or 50 mm orifice. In some embodiments, the formulations are packed in a 5 mL borosilicate glass vial with a 20 mm orifice. In some embodiments, the formulations are packed in a 10 mL borosilicate glass vial with a 20 mm orifice. The containers, bottles and/or vials can be equipped with suitable caps or stoppers. In some embodiments, the vials are equipped with a vinyl stopper. In some embodiments the formulations are packed in a 10 mL glass vial, with a 20 mm orifice, equipped with vinyl stoppers. The stoppers can be coated with FluroTek®. The containers, bottles and/or can also be equipped with a seal, for example, crimped-on flip-off caps. The seal can be aluminum and/or plastic. The container can be a glass ampoule.

In some embodiments, the containers, including the vials and the bottles, can be inspected for visible particulates, glass defects, and/or stopper/cap integrity before packaging the formulations therein. In some embodiments, the containers, including the vials and the bottles, can be inspected for visible particulates, glass defects, and/or stopper/cap integrity after packaging the formulations therein. In some embodiments, the containers, including the vials and the bottles, can be inspected for visible particulates, glass defects, and/or stopper/cap integrity before and/or after packaging the formulations therein. The containers, including the vials and the bottles, can also be additionally inspected for fill height after packaging the formulations therein. The inspection can be visual inspections and can be carried out under any convenient condition, for example in front of a black and white background.

A kit can also include labels listing contents and/or instructions for use, and package inserts with instructions for use. A set of instructions will also typically be included. In one embodiment, a label is on or associated with the container. In one embodiment, a label is on a container when letters, numbers or other characters forming the label are attached, molded or etched into the container itself; a label is associated with a container when it is present within a receptacle or carrier that also holds the container. e.g., as a package insert. In one embodiment, a label is used to indicate that the contents are to be used for a specific therapeutic application. The label also indicates directions for use of the contents, such as in the methods described herein. The labels can optionally indicate one or more items selected from a group comprising the date of manufacturing of the formulation, the recommended storage conditions, intended mode of administration for the formulation, the amount of formulation enclosed and/or the concentration of the peptidomimetic macrocycle. The labels can further include any applicable warnings and/or possible side effects.

In certain embodiments, the pharmaceutical formulations are presented in a pack or dispenser device which contains one or more unit dosage forms containing a formulation provided herein. The pack, for example, contains metal or plastic foil, such as a blister pack. In one embodiment, the pack or dispenser device is accompanied by instructions for administration. In one embodiment, the pack or dispenser is also accompanied with a notice associated with the container in form prescribed by a governmental agency regulating the manufacture, use, or sale of pharmaceuticals, which notice is reflective of approval by the agency of the form of the drug for human or veterinary administration. Such notice, for example, is the labeling approved by the U.S. Food and Drug Administration for prescription drugs, or the approved product insert. In one embodiment, formulations containing a compound provided herein formulated in a compatible pharmaceutical carrier are also prepared, placed in an appropriate container, and labeled for treatment of an indicated condition.

EXAMPLES

Example 1: Peptidomimetic Macrocycles

Peptidomimetic macrocycles were synthesized, purified and analyzed as previously described and as described below (Schafmeister et al., J. Am. Chem. Soc. 122:5891-5892 (2000); Schafmeister & Verdine, J. Am. Chem. Soc. 122:5891 (2005); Walensky et al., Science 305:1466-1470 (2004); and U.S. Pat. No. 7,192,713). Peptidomimetic macrocycles were designed by replacing two or more naturally occurring amino acids with the corresponding synthetic amino acids. Substitutions were made at i and i+4, and i and i+7 positions. Peptide synthesis was performed either manually or on an automated peptide synthesizer (Applied Biosystems, model 433A), using solid phase conditions, rink amide AM resin (Novabiochem), and Fmoc main-chain protecting group chemistry. For the coupling of natural Fmoc-protected amino acids (Novabiochem), 10 equivalents of amino acid and a 1:1:2 molar ratio of coupling reagents HBTU/HOBt (Novabiochem)/DIEA were employed. Non-natural amino acids (4 equiv) were coupled with a 1:1:2 molar ratio of HATU (Applied Biosystems)/HOBt/DIEA. The N-termini of the synthetic peptides were acetylated, while the C-termini were amidated.

Purification of cross-linked compounds was achieved by high performance liquid chromatography (HPLC) (Varian ProStar) on a reverse phase C18 column (Varian) to yield the pure compounds. Chemical composition of the pure products was confirmed by LC/MS mass spectrometry (Micromass LCT interfaced with Agilent 1100 HPLC system) and amino acid analysis (Applied Biosystems, model 420A).

The following protocol was used in the synthesis of dialkyne-crosslinked peptidomimetic macrocycles, including SP662, SP663 and SP664. Fully protected resin-bound peptides were synthesized on a PEG-PS resin (loading 0.45 mmol/g) on a 0.2 mmol scale. Deprotection of the temporary Fmoc group was achieved by 3×10 min treatments of the resin bound peptide with 20% (v/v) piperidine in DMF. After washing with NMP (3×), dichloromethane (3×) and NMP (3×), coupling of each successive amino acid was achieved with 1×60 min incubation with the appropriate preactivated Fmoc-amino acid derivative. All protected amino acids (0.4 mmol) were dissolved in NMP and activated with HCTU (0.4 mmol) and DIEA (0.8 mmol) prior to transfer of the coupling solution to the deprotected resin-bound peptide. After coupling was completed, the resin was washed in preparation for the next deprotection/coupling cycle. Acetylation of the amino terminus was carried out in the presence of acetic anhydride/DIEA in NMP. The LC-MS analysis of a cleaved and deprotected sample obtained from an aliquot of the fully assembled resin-bound peptide was accomplished in order to verifying the completion of each coupling. In a typical example, tetrahydrofuran (4 ml) and triethylamine (2 ml) were added to the peptide resin (0.2 mmol) in a 40 ml glass vial and shaken for 10 minutes. Pd(PPh$_3$)$_2$Cl$_2$ (0.014 g, 0.02 mmol) and copper iodide (0.008 g, 0.04 mmol) were then added and the resulting reaction mixture was mechanically shaken 16 hours while open to atmosphere. The diyne-cyclized resin-bound peptides were deprotected and cleaved from the solid support by treatment with TFA/H$_2$O/TIS (95/5/5 v/v) for 2.5 h at room temperature. After filtration of the resin the TFA solution precipitated in cold diethyl ether and centrifuged to yield the desired product as a solid. The crude product was purified by preparative HPLC.

The following protocol was used in the synthesis of single alkyne-crosslinked peptidomimetic macrocycles, including SP665. Fully protected resin-bound peptides were synthesized on a Rink amide MBHA resin (loading 0.62 mmol/g) on a 0.1 mmol scale. Deprotection of the temporary Fmoc group was achieved by 2×20 min treatments of the resin bound peptide with 25% (v/v) piperidine in NMP. After extensive flow washing with NMP and dichloromethane, coupling of each successive amino acid was achieved with 1×60 min incubation with the appropriate preactivated Fmoc-amino acid derivative. All protected amino acids (1 mmol) were dissolved in NMP and activated with HCTU (1 mmol) and DIEA (1 mmol) prior to transfer of the coupling solution to the deprotected resin-bound peptide. After coupling was completed, the resin was extensively flow washed in preparation for the next deprotection/coupling cycle. Acetylation of the amino terminus was carried out in the presence of acetic anhydride/DIEA in NMP/NMM. The LC-MS analysis of a cleaved and deprotected sample obtained from an aliquot of the fully assembled resin-bound peptide was accomplished in order to verifying the completion of each coupling. In a typical example, the peptide resin (0.1 mmol) was washed with DCM. Resin was loaded into a microwave vial. The vessel was evacuated and purged with nitrogen. Molybdenumhexacarbonyl (0.01 eq, Sigma Aldrich 199959) was added. Anhydrous chlorobenzene was added to the reaction vessel. Then 2-fluorophenol (1 eq, Sigma Aldrich F12804) was added. The reaction was then loaded into the microwave and held at 130° C. for 10 minutes. Reaction can need to be pushed a subsequent time for completion. The alkyne metathesized resin-bound peptides were deprotected and cleaved from the solid support by treatment with TFA/H$_2$O/TIS (94/3/3 v/v) for 3 h at room temperature. After filtration of the resin the TFA solution was precipitated in cold diethyl ether and centrifuged to yield the desired product as a solid. The crude product was purified by preparative HPLC.

Table 1 shows a list of peptidomimetic macrocycles that were prepared. Table 1a, Table 1b, Table 1c and Table 1d shows a selection of peptidomimetic macrocycles. In some embodiments, peptidomimetic macrocycles exclude peptidomimetic macrocycles shown in Table 2a. In some embodiments, peptidomimetic macrocycles do not comprise a peptidomimetic macrocycle structure as shown in Table 2a. In other embodiments, peptidomimetic macrocycles exclude peptidomimetic macrocycles shown in Table 2b. In some embodiments, the peptidomimetic macrocycles disclosed herein do not comprise a peptidomimetic macrocycle structure as shown in Table 2b.

Example 2: Preparation of a Pharmaceutical Formulation 1-Liter Peptidomimetic Formulation Batch Aileron peptide 1 is formulated as a pharmaceutical formulation. Aileron peptide 1 is an alpha helical hydrocarbon cross-linked polypeptide macrocycle, with an amino acid sequence less than 20 amino acids long that is derived from the transactivation domain of wild type human P53 protein and that contains a phenylalanine, a tryptophan and a leucine amino acid in the same positions relative to each other as in the transactivation domain of wild type human P53 protein. Aileron peptide 1 has a single cross link spanning amino acids in the i to the i+7 position of the amino acid sequence and has more than three amino acids between the i+7 position and the carboxyl terminus. Aileron peptide 1 binds to human MDM2 and MDM4 and has an observed mass of 950-975 m/e as measured by electrospray ionization-mass spectrometry.

For each liter of formulated Aileron peptide 1 the peptides is sequentially dissolve in 900 mL of water for injection 182 mg monosodium phosphate, monohydrate, 2,968 mg disodium phosphate, anhydrous, and 82.2 g of D-trehalose. Add 3.0 mL of a 10% (w/w) aqueous solution of Polysorbate 20. Slowly add 15,000 mg Aileron peptide 1 divided by peptide content divided by peptide purity to the solution under stirring. E.g., if the peptide content is 94.3% and the peptide purity is 98.2%, 15,000/94.3*100/98/100 or 16,215 mg of bulk-Aileron peptide 1 would have to be added. While the peptide is dissolving the pH of the solution is kept between 7.5 and 7.7 by the addition of 0.1 N sodium hydroxide.

After all peptide is dissolved, adjust pH of the solution to 7.5±0.1 with sodium hydroxide and subsequently q.s. with WFI to 1,000 mL. Stir solution for 5 minutes and then clarify solution by passing it through a 0.22-μm PVDF-membrane filter.

Example 3: Sterile Filtration and Fill

The formulated product is filtered through two serial sterilization 0.22 µm PVDF membrane filters into a sterile container that is equipped with the fill needle. The filling process starts after both filters have passed the post filtration filter integrity test. If one or both filters do not pass the post filtration integrity test, the tandem sterile filtration process is repeated until both filters pass the test.

All vials are inspected for visible particulates, glass faults, fill high and stopper/cap integrity in front of a white and black background. Approximately 180 vial containers are then filled per 1-liter batch to a level of 5.2 mL to 5.7 mL each, with a fill target of 5.5 mL (the label claim is 5.0 mL). Fill volume accuracy is verified throughout the fill process. The filling machine loaded with vials and stoppers immediately stoppers each vial after it is filled. Capping occurs in line with filling and stopping or can occur separately under ISO Class 5 supply air. Weight check of the contents of the filled vials is performed throughout the filling process to assure that the vials receive the specified fill volume. Any rejected vials are discarded.

Example 4: Stability Analysis

To render the stability study more challenging 2 mL vials with 13 mm 0 stoppers and a fill volume of 1.0 mL were selected. The smaller vial size provided a greater surface to volume ratio which would amplify any container/closure effects on product stability. To assure that all surfaces of vial were challenged, the vials were stored in an inverted position. The tested storage conditions on inverted vials are: −20° C., +5° C., +25° C., and +40° C. RH.

The results of this study are depicted in Table 5. There is no appreciable purity loss at storage temperatures between between −20° C. and +25° C. over the 6-month test period and only about a 1.8% purity loss of the sample that is stored at 40° C. over the same period. The observed small but continuous increase of RRT values between 0.22 and 0.81 in the 40'C samples attests to both, the excellent detecting power and stability-indicating capability of the RP-HPLC (TFA) method. The peptidomimetic macrocycle concentration stayed within an acceptable ±4% range over the 6-month period for all samples independent of the storage temperature.

TABLE 5

Product stability results of Aileron peptide1 formulated at 15 mg/mL in 20 mM sodium phosphate, 240 mM trehalose, 300 ppm Polysorbate 20 buffer in a 5-fold scaled-down, inverted container/closure configuration to amplify any potential product degrading effects by the container/closure surface.

| | Time Points | | | | | | | | |
|---|---|---|---|---|---|---|---|---|---|
| | Intial | 1 month | | | | 2 Months | | | |
| Storage | −20° C. | −20° C. | 5° C. | 25° C. | 40° C. | −20° C. | 5° C. | 25° C. | 40° C. |
| Assay [%] | | 100% | 97% | 96% | 99% | 103% | 104% | 101% | 102% |
| Purity [%] | 95.5% | 95.9% | 95.8% | 96.1% | 96.0% | 95.8% | 96.2% | 96.1% | 95.6% |
| Individual Impurities > 0.1% | | | | | | | | | |
| ~RRT 0.22 | | | | | | | | | 0.08% |
| ~RRT 0.32 | | | | | | | | | 0.09% |
| ~RRT 0.47 | | | | | | | | | 0.08% |
| ~RRT 0.81 | | | | | | | | | 0.08% |
| ~RRT 0.84 | 0.11% | | | | 0.06% | | | | 0.13% |
| ~RRT 0.88 | 0.17% | 0.12% | 0.12% | 0.13% | 0.13% | 0.14% | | 0.14% | 0.14% |
| ~RRT 0.90 | 0.22% | 0.16% | 0.19% | 0.18% | 0.18% | 0.16% | 0.15% | 0.20% | 0.20% |
| ~RRT 0.93 | 0.54% | 0.47% | 0.50% | | | | 0.51% | 0.44% | |
| ~RRT 1.03 | 2.24% | 2.21% | 2.22% | 2.20% | 2.20% | 2.18% | 2.13% | 2.27% | 2.27% |
| ~RRT 1.04 | 0.17% | 0.11% | 0.12% | 0.17% | 0.17% | 0.15% | 0.13% | ND | ND |
| ~RRT 1.06 | | | | 0.10% | 0.10% | | | 0.14% | 0.14% |
| ~RRT 1.07 | 0.12% | 0.13% | 0.15% | 0.16% | 0.16% | 0.11% | 0.07% | 0.14% | 0.14% |
| ~RRT 1.10 | 0.95% | 0.95% | 0.93% | 0.93% | 0.99% | 0.98% | 0.89% | 1.00% | 1.06% |
| Particulate Matter [Number of particles per container] | | | | | | | | | |
| <10 µm | <1 | | | | | <1 | <1 | <1 | <1 |
| >10 µm | 140 | | | | | 38 | 23 | | 28 |
| >25 µm | 33 | | | | | 7 | 6 | | 5 |
| >50 µm | 4 | | | | | 2 | 3 | | 2 |

| | Time Points | | | | | | | |
|---|---|---|---|---|---|---|---|---|
| | 3 months | | | | 6 months | | | |
| Storage | −20° C. | 5° C. | 25° C. | 40° C. | −20° C. | 5° C. | 25° C. | 40° C. |
| Assay [%] | 99% | 99% | 99% | 97% | 100% | 99% | 99% | 96% |
| Purity [%] | 95.9% | 95.8% | 96.0% | 95.2% | 95.7% | 95.5% | 95.7% | 93.9% |
| Individual Impurities > 0.1% | | | | | | | | |
| ~RRT 0.22 | | | | 0.08% | | | | 0.16% |
| ~RRT 0.32 | | | | 0.14% | | | | 0.33% |
| ~RRT 0.47 | | | | 0.14% | | | | 0.25% |
| ~RRT 0.81 | | | | 0.12% | | | | 0.25% |
| ~RRT 0.84 | | | | 0.14% | | | | 0.25% |
| ~RRT 0.88 | | | 0.13% | 0.13% | 0.14% | 0.17% | 0.09% | 0.18% |
| ~RRT 0.90 | 0.18% | 0.17% | 0.21% | 0.21% | 0.19% | 0.21% | 0.20% | 0.23% |
| ~RRT 0.93 | 0.50% | 0.51% | | | 0.55% | 0.54% | 0.49% | 0.52% |

TABLE 5-continued

Product stability results of Aileron peptide1 formulated at 15 mg/mL in 20 mM sodium phosphate, 240 mM trehalose, 300 ppm Polysorbate 20 buffer in a 5-fold scaled-down, inverted container/closure configuration to amplify any potential product degrading effects by the container/closure surface.

| ~RRT 1.03 | 2.23% | 2.24% | 2.40% | 2.40% | 2.15% | 2.24% | 2.21% | 2.30% |
|---|---|---|---|---|---|---|---|---|
| ~RRT 1.04 | 0.14% | 0.14% | | | 0.19% | 0.15% | 0.12% | 0.16% |
| ~RRT 1.06 | 0.00% | 0.00% | 0.16% | 0.16% | 0.09% | 0.09% | 0.13% | 0.13% |
| ~RRT 1.07 | 0.15% | 0.15% | 0.17% | 0.17% | 0.12% | 0.18% | 0.12% | 0.16% |
| ~RRT 1.10 | 0.95% | 0.96% | 0.99% | 1.08% | 0.92% | 0.97% | 0.99% | 1.20% |

Particulate Matter [Number of particles per container)

| <10 μm | <2 | <1 | <1 | ~8 |
|---|---|---|---|---|
| >10 μm | | | | 31 |
| >25 μm | | | | 3 |
| >50 μm | | | | 0 |

RRT = relative retention time.

Example 5: Comparative Data for TRIS and Phosphate Buffers

Composition of Formulations

Two formulations, F1 and F2 were formulated. Table 6 shows the compositions of the two formulations. Formulations were filled into 6 mL, Ø 20 mm, colorless vials. The vials were equipped with teflon serum-stoppers D777-1, Ø 20 mm and aluminum caps without PP-cap, Ø 20 mm. 6 vials of each formulation were prepared. The vials were stored at 2-8° C. Exposure to direct sunlight was avoided.

TABLE 6

Composition of formulations F1 and F2:

| Peptidomimetic Macrocycle | Formulation Code | Buffer system | Excipient | Surfactant % | Peptide (mg/ml) |
|---|---|---|---|---|---|
| Aileron peptide 1 | F1 | 20 mM Na-Phosphate pH 7.5 | 240 mM Trehalose | 0.03 | 15 |
| | F2 | 20 mM Tris pH 7.5 | | 0.03 | |

Two placebo formulations P1 (with 20 mM Na-phosphate buffer) and P2 (with 20 mM Tris buffer), without the peptidomimetic macrocycle, were also prepared.

Figure 2:
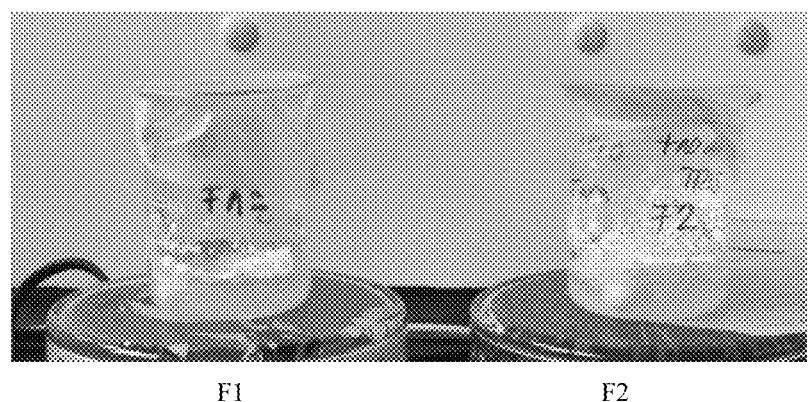
FIG. 2. Shows the observation pictures for Example 5.
Figure 2:
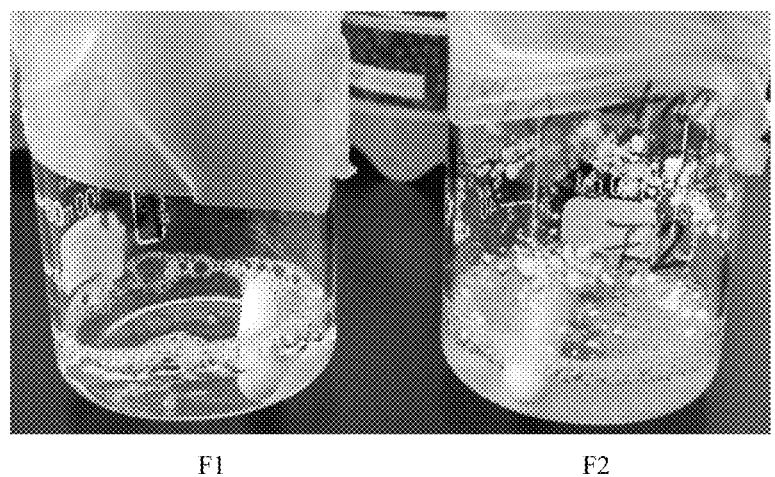

Every filled 6 ml vial was visually inspected using Seidenader. The results of this observation are summarized in Table 7. The observation images are shown in FIG. 2.

TABLE 7

Comparative visual inspection of F1, F2, P1, and P2 indicate that the resulting formulations were comparable and yielded minimal visible particles.

| Form. Code | total filled/ inspected | no. of vials with particles | | | | notes |
|---|---|---|---|---|---|---|
| | | 0 | 1-5 | 6-10 | >10 | |
| F1 | 6 | | 4 | 2 | | 1x faster 1x particle |
| F2 | 6 | 6 | | | | |
| P1 | 6 | | 5 | 1 | | 1x faster |
| P2 | 6 | 6 | | | | |

Example 6: Shelf Life of the Peptidomimetic Macrocycles of the Invention

Figure 4:
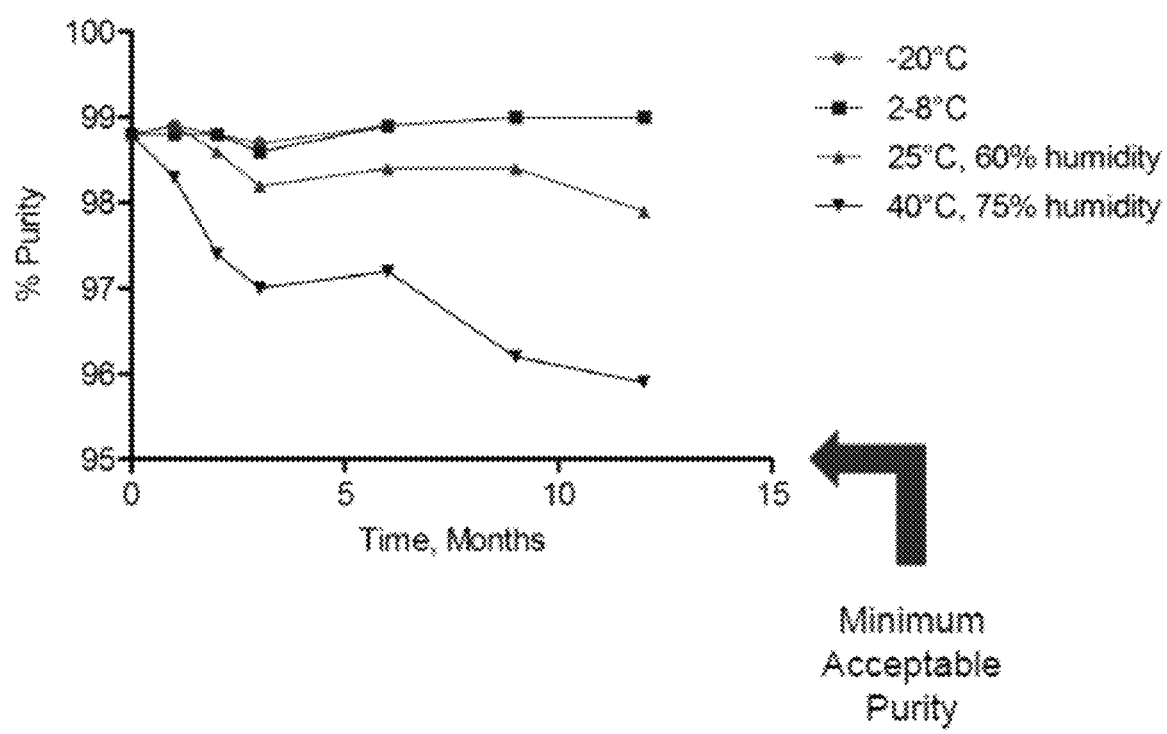
FIG. 4 Shows the 12-month stability results for Aileron peptide-1. The data support greater than 2 year shelf life at −20-5° C.

A pharmaceutical formulation of Aileron peptide 1, was formulated as described above and stored at varying temperatures (−20° C., 2-8° C., 25° C. 60% humidity and 40° C. 75% humidity. The purity of the samples was analyzed at regular time intervals. The results of these experiments for Aileron peptide 1 are summarized in FIG. 4. These experiments support a greater than 2 year shelf life at −20° C. and 2-8° C.

Example 7

Stability Testing of Aileron Peptide 1 was Performed on a Pharmaceutical Formulation formulated as described above and stored at varying temperatures (−20° C., 2-8° C., 25° C. 60% humidity and 40° C. 75% humidity. The purity of the samples was analyzed at regular time intervals. The results of these experiments for Aileron peptide 1 are summarized in Tables 8, 9, 10, and 11.

TABLE 8

| | Storage: −20° C. | | | | | | |
|---|---|---|---|---|---|---|---|
| | Initial | 1 Month | 2 Months | 3 Months | 6 Months | 9 Months | 12 Months |
| Appearance[1] | Conforms | Conforms | Conforms | Conforms | Conforms | Conforms | Conforms |
| pH[2] | 7.6 | 7.6 | 7.6 | 7.6 | 7.6 | 7.6* | 7.6 |
| Assay [mg/mL] | 15.6 | 15.6 | 15.9 | 15.6 | 15.4 | 15.5 | 15.6 |
| Purity [%][3] | 99.0 | 99.0 | 98.9 | 98.9 | 98.9 | 99.0 | 99.0 |
| Impurities [%][4] | 0.4% @ 0.89 | 0.4% @ 0.89 | 0.4% @ 0.89 | 0.4% @ 0.89 | 0.4% @ 0.89 | 0.4% @ 0.88 | 0.4% @ 0.88 |
| | 0.4% @ 0.91 | 0.4% @ 0.91 | 0.5% @ 0.91 | 0.5% @ 0.91 | 0.5% @ 0.91 | 0.4% @ 0.91 | 0.4% @ 0.91 |
| | 0.2% @ 1.02 | 0.2% @ 1.02 | 0.2% @ 1.02 | 0.2% @ 1.02 | 0.2% @ 1.02 | 0.2% @ 1.02 | 0.2% @ 1.02 |

TABLE 8-continued

| | Storage: −20° C. | | | | | | |
|---|---|---|---|---|---|---|---|
| | Initial | 1 Month | 2 Months | 3 Months | 6 Months | 9 Months | 12 Months |
| Particulate Matter[5] | 184 | | | | 18 | | 557 |
| CCIT[6] | 63 | | | | 0 | | 8 |
| Endotoxin[7] | conforms <1.8 EU/mL | | | | | | conforms <1.6 EU/mL |

TABLE 9

| | Storage: +5° C. | | | | | | |
|---|---|---|---|---|---|---|---|
| | Initial | 1 Month | 2 Months | 3 Months | 6 Months | 9 Months | 12 Months |
| Appearance[1] | Conforms | Conforms | Conforms | Conforms | Conforms | Conforms | Conforms |
| pH[2] | 7.6 | 7.6 | 7.6 | 7.7 | 7.7 | 7.6 | 7.6 |
| Assay [mg/mL] | 15.6 | 15.7 | 15.8 | 15.8 | 15.5 | 15.6 | 15.6 |
| Purity [%][3] | 99.0 | 99.0 | 99.0 | 99.0 | 98.9 | 99.0 | 99.0 |
| Impurities [%][4] | 0.4% @ 0.89 | 0.4% @ 0.89 | 0.4% @ 0.89 | 0.4% @ 0.89 | 0.4% @ 0.89 | 0.4% @ 0.89 | 0.4% @ 0.89 |
| | 0.4% @ 0.91 | 0.4% @ 0.91 | 0.4% @ 0.91 | 0.4% @ 0.91 | 0.5% @ 0.91 | 0.4% @ 0.91 | 0.4% @ 0.91 |
| | 0.2% @ 1.02 | 0.2% @ 1.02 | 0.2% @ 1.02 | 0.2% @ 1.02 | 0.2% @ 1.02 | 0.2% @ 1.02 | 0.2% @ 1.02 |
| Particulate Matters[5] | 184 | 1 | | | 37 | | 171 |
| CCIT[6] | 63 | | | | 4 | | 11 |
| Endotoxin[7] | conforms <1.8 EU/mL | | | | | | conforms <1.6 EU/mL |

TABLE 10

| | Storage: +25° C./60% RH | | | | | | |
|---|---|---|---|---|---|---|---|
| | Initial | 1 Month | 2 Months | 3 Months | 6 Months | 9 Months | 12 Months |
| Appearance[1] | Conforms | Conforms | Conforms | Conforms | Conforms | Conforms | Conforms |
| pH[2] | 7.6 | 7.65 | 7.6 | 7.6 | 7.7 | 7.6 | 7.6 |
| Assay [mg/mL] | 15.6 | 15.6 | 15.8 | 15.4 | 15.2 | 15.1 | 15.0 |
| Purity [%][3] | 99.0 | 99.0 | 98.9 | 98.7 | 98.4 | 98.4 | 97.9 |
| Impurities [%][4] | | | | 0.2% @ 0.23 | 0.3% @ 0.23 | 0.4% @ 0.23 | 0.5% @ 0.23 |
| | | | | | | | 0.2% @ 0.32 |
| | | | | 0.1% @ 0.82 | | | 0.4 @ 0.82 |
| | 0.4% @ 0.89 | 0.4% @ 0.89 | 0.4% @ 0.89 | 0.4% @ 0.89 | 0.4% @ 0.89 | 0.4% @ 0.89 | 0.4% @ 0.88 |
| | 0.4% @ 0.91 | 0.4% @ 0.91 | 0.4% @ 0.91 | 0.4% @ 0.91 | 0.4% @ 0.91 | 0.4% @ 0.91 | 0.4% @ 0.91 |
| | 0.2% @ 1.02 | 0.2% @ 1.02 | 0.2% @ 1.02 | 0.2% @ 1.02 | 0.2% @ 1.02 | 0.2% @ 1.02 | 0.2% @ 1.02 |
| Particulate Matter[5] | 184 | | | | 5 | | 185 |
| CCIT[6] | 63 | | | | 1 | | 8 |
| Endotoxin[7] | conforms <1.8 EU/mL | | | | | | conforms <1.6 EU/mL |

[1]Visual appearance Specification: Upon thawing, clear, colorless, particulate-free solution
[2]pH Specification: 7.3 to 7.7
[3]Purity by RP-HPLC(TFA) Specification: ≥95%; no single impurity >3%
[4]>0.1% Impurities listed by RRT
[5]USP <788> (light obstruction) Specification: ≤6,000 particles ≥10 μm and ≤600 particles ≥25 μm per vial (upper cell: ≥10 μm particles; lower cells: ≥25 μm particles
[6]CCIT Specification: No dye intrusion
[7]Endotoxin: ≤4.4 EU/mL (based upon maximum patient dose of 17 mg ALRN-6924 per Kg of patient weight)

TABLE 11

| | Storage: +40° C./75% RH | | | | | | |
|---|---|---|---|---|---|---|---|
| | Initial | 1 Month | 2 Months | 3 Months | 6 Months | 9 Months | 12 Months |
| Appearance[1] | conforms | conforms | conforms | OOS* | OOS** | OOS** | OOS** |
| pH[2] | 7.6 | 7.64 | 7.6 | 7.6 | 7.6 | 7.5 | 7.5 |
| Assay [mg/mL] | 15.6 | 15.6 | 15.4 | 15.1 | 14.6 | 14.4 | 14.1 |
| Purity [%][3] | 99.0 | 98.8 | 98.6 | 98.1 | 97.2 | 96.2 | 95.9 |
| Impurities: [%][4] | | | | | 0.3 @ 01.9 | 0.3 @ 01.9 | 0.3 @ 01.9 |
| | | | | | | 0.2 @ 020 | 0.2 @ 020 |
| | n.d. | 0.2% @ 0.23 | 0.2% @ 0.23 | 0.2% @ 0.23 | 0.4% @ 0.23 | 0.3% @ 0.23 | 0.3% @ 0.23 |
| | | | | | | 0.3% @ 0.24 | 0.3% @ 024 |
| | | | | | | 0.2% @ 0.29 | 0.2% @ 0.29 |
| | | | 0.2% @ 0.34 | 0.2% @ 0.34 | 0.2% @ 0.34 | 0.3% @ 0.33 | 0.3% @ 0.32 |
| | | | | | | | 0.2% @ 0.36 |
| | | | | | 0.2% @ 0.48 | 0.2% @ 0.47 | 0.2% @ 0.47 |
| | | | | | | 0.2% @ 0.74 | 0.2% @ 0.74 |
| | | | | 0.2% @ 0.83 | 0.3% @ 0.83 | 0.3% @ 0.82 | 0.4% @ 0.82 |
| | 0.4% @ 0.89 | 0.4% @ 0.89 | 0.4% @ 0.89 | 0.4% @ 0.89 | 0.4% @ 0.89 | 0.4% @ 0.88 | 0.4% @ 0.88 |
| | 0.4% @ 0.91 | 0.4% @ 0.91 | 0.4% @ 0.91 | 0.4% @ 0.91 | 0.4% @ 0.91 | 0.4% @ 0.91 | 0.4% @ 0.91 |
| | 0.2% @ 1.02 | 0.2% @ 1.02 | 0.2% @ 1.02 | 0.3% @ 1.02 | 0.4% @ 1.04 | 0.5% @ 1.02 | |
| | | | | 0.2% @ 1.10 | 0.4% @ 1.10 | 0.4% @ 1.10 | 0.5% @ 1.11 |

OOS*: Solution turned yellow
OOS**: Solution turned yellow (nonconformance confirmed)

Example 8: Stability Testing of Aileron Peptide 1

Aileron peptide 1 was performed on a pharmaceutical formulation formulated at a concentration of 15 mg/mL (20 mM sodium phosphate, 240 mM D-Trehalose, 330 ppm polysorbate 20, pH 7.5). 5 mL of this formulation was stored in a 10 mL clear serum vial (20 mm FluroTec®-coated stopper; 20 mm Flip-off™ seal). The formulation was stored at −15° C. and was tested at regular intervals. The results of this analysis are summarized in Table 12.

TABLE 12

| Attribute | Test | Specification | Results |
|---|---|---|---|
| | Appearance | Upon thawing: Clear, colorless, particulate-free solution | Conforms |
| Identity | PH | 7.5 ± 0.2 | 7.6 |
| | Osmolality | 220 to 400 mOsmol/Kg | 327 |
| | RP-HPLC (TFA) | Co-elutes with ALRN-6924 reference standard | Conforms |
| Potency | qRP-HPLC (TFA) | 15 ± 1.5 mg/mL | 15.6 |
| Purity | RP-HPLC(TFA) | Purity ≥95% by area integration | 99.0% |
| | | no single impurity >3%[1] | RRT 0.88: 0.4% |
| | | | RRT 0.91: 0.4% |
| | | | RRT 1.02: 0.2% |
| Safety | Particulate matter USP <788> | ≥10 μm: ≤6,000 particulates/vial ≥25 μm: ≤600 particulates/vial | ≥10 μm: 557 ≥25 μm: 8 |
| | Endotoxin, USP <85> | ≤4.4 EU/mL[2] | <1.6 EU/mL |

TABLE 12-continued

| Attribute | Test | Specification | Results |
|---|---|---|---|
| | Container/Closure Integrity | No dye intrusion | Conforms |
| | Sterility; USP <71> (Membrane Filtration) | No growth | No growth |

[1]Impurities >0.1% are listed based on their relative retention time (RRT) with respect to the Aileron peptide 1peptide peak.
[2]Based on a maximum patient dose of 17 mg Aileron peptide 1 per Kg of patient weight.

Example 9: Stability Testing of Multiple Batches of Aileron Peptide 1 Under Varying Storage Conditions Samples 1-7 of Aileron peptide 1 were formulated at a concentration of 15 mg/mL (20 mM sodium phosphate, 240 mM D-Trehalose, 330 ppm polysorbate 20, pH 7.5). These samples were stored under different storage conditions as described in Table 13. The formulations were tested for appearances and purity. The results are summarized in Tables 14-16 below.

TABLE 13

| Sample Number | Sample Description |
|---|---|
| Sample 1 | Aileron peptide 1 Drug product configuration Upright 15 mg/mL 12 month −20° C. (/−5° C.) |

TABLE 13-continued

| Sample Number | Sample Description |
|---|---|
| Sample 2 | Aileron peptide 1 Drug product configuration Upright Storage Only/Return 15 mg/mL 12 month −20° C. (+/−5° C.) |
| Sample 3 | Aileron peptide 1 Drug product configuration Inverted Storage Only/Return 15 mg/mL 12 month 25° C./60% RH (+/−2° C./+/−5% RH) |
| Sample 4 | Aileron peptide 1Drug product configuration Inverted 15 mg/mL 12 month 25° C./60% RH (+/−2° C./+/−5% RH) |
| Sample 5 | Aileron peptide 1Drug product configuration Inverted Storage Only/Return 15 mg/mL 12 month 5° C. (+/−3° C.) |
| Sample 6 | Aileron peptide 1Drug product configuration Inverted 15 mg/mL 12 month 5° C. (+/−3° C.) |
| Sample 7 | Aileron peptide 1Drug product configuration Inverted 15 mg/mL 12 month 40° C./75%RH (+/−2° C./+/−5% RH) |

TABLE 14

Results of analysis of sample 1.

| Test | Acceptance Criteria | Test Result(s) |
|---|---|---|
| Appearance | Upon thawing: Clear, colorless, particulate-free solution | Clear, colorless, particulate-free solution. Meets acceptance criteria. |
| pH | 7.3 to 7.7 | 7.63 Meets acceptance criteria. |
| RP_HPLC (TFA) for Aileron peptide-1Concentration | ≥13.5 mg/mL; ≤16.5 mg/mL | Injection #1 = 15.58 mg/mL Injection #2 = 15.54 mg/mL Mean = 15.6 mg/mL Meets acceptance criteria. |
| RP_HPLC (TFA) Purity by Area Integration | ≥95% for ALRN-6924 peak | Injection #1 = 98.6% Injection #2 = 98.6% Mean = 98.6% Meets acceptance criteria. |
| RP_HPLC (TFA) Purity by Area Integration for: Largest Impurity (RRT 0.91) | No single impurity >3% | Injection #1 = 0.41% Injection #2 = 0.42% Mean = 0.41% Meets acceptance criteria. |
| RP_HPLC (TFA) Purity by Area Integration for: Impurity (RRT 0.87) | Report Result ≥0.1% | Injection #1 = 0.07% Injection #2 = 0.07% Mean = 0.07% |
| RP_HPLC (TFA) Purity by Area Integration for: Impurity (RRT 0.88) | Report Result ≥0.1% | Injection #1 = 0.39% Injection #2 = 0.39% Mean = 0.39% |
| RP_HPLC (TFA) Purity by Area Integration for: Impurity (RRT 0.94) | Report Result ≥0.1% | Injection #1 = 0.11% Injection #2 = 0.10% Mean = 0.11% |
| RP_HPLC (TFA) Purity by Area Integration for: Impurity (RRT 1.02) | Report Result ≥0.1% | Injection #1 = 0.16% Injection #2 = 0.14% Mean = 0.15% |
| RP_HPLC (TFA) Purity by Area Integration for: Impurity (RRT 1.04) | Report Result ≥0.1% | Injection #1 = 0.09% Injection #2 = 0.09% Mean = 0.09% |
| RP_HPLC (TFA) Purity by Area Integration for: Impurity (RRT 1.10) | Report Result ≥0.1% | Injection #1 = 0.07% Injection #2 = 0.07% Mean = 0.07% |
| Total Impurities | Information | 1.3% |

TABLE 15

Results of analysis of sample 4.

| Test | Acceptance Criteria | Test Result(s) |
|---|---|---|
| Appearance | Upon thawing: Clear, colorless, particulate-free solution | Clear, colorless, particulate-free solution. Meets acceptance criteria. |
| pH | 7.3 to 7.7 | 7.64 Meets acceptance criteria. |

TABLE 15-continued

Results of analysis of sample 4.

| Test | Acceptance Criteria | Test Result(s) |
|---|---|---|
| RP_HPLC (TFA) for: Aileron peptide-1TEConcentration | ≥13.5 mg/mL; ≤16.5 mg/mL | Injection #1 = 14.98 mg/mL<br>Injection #2 = 15.00 mg/mL<br>Mean = 15.0 mg/mL<br>Meets acceptance criteria. |
| RP_HPLC (TFA) Purity by Area Integration | ≥95% for Aileron peptide-1 peak | Injection #1 = 96.3%<br>Injection #2 = 96.3%<br>Mean = 96.3%<br>Meets acceptance criteria. |
| RP_HPLC (TFA) Purity by Area Integration for: Largest Impurity (RRT 0.23) | No single impurity >3% | Injection #1 = 0.47%<br>Injection #2 = 0.47%<br>Mean = 0.47%<br>Meets acceptance criteria. |
| RP_HPLC (TFA) Purity by Area Integration for: Impurity (RRT 0.16) | Report Result ≥0.1% | Injection #1 = 0.11%<br>Injection #2 = 0.11%<br>Mean = 0.11% |
| RP_HPLC (TFA) Purity by Area Integration for: Impurity (RRT 0.19) | Report Result ≥0.1% | Injection #1 = 0.13%<br>Injection #2 = 0.13%<br>Mean = 0.13% |
| RP_HPLC (TFA) Purity by Area Integration for: Impurity (RRT 0.22) | Report Result ≥0.1% | Injection #1 = 0.07%<br>Injection #2 = 0.07%<br>Mean = 0.07% |
| RP_HPLC (TFA) Purity by Area Integration for: Impurity (RRT 0.24) | Report Result ≥0.1% | Injection #1 = 0.10%<br>Injection #2 = 0.10%<br>Mean = 0.10% |
| RP_HPLC (TFA) Purity by Area Integration for: Impurity (RRT 0.25A) | Report Result ≥0.1% | Injection #1 = 0.07%<br>Injection #2 = 0.06%<br>Mean = 0.06% |
| RP_HPLC (TFA) Purity by Area Integration for: Impurity (RRT 0.25B) | Report Result ≥0.1% | Injection #1 = 0.06%<br>Injection #2 = 0.05%<br>Mean = 0.06% |
| RP_HPLC (TFA) Purity by Area Integration for: Impurity (RRT 0.28) | Report Result ≥0.1% | Injection #1 = 0.15%<br>Injection #2 = 0.11%<br>Mean = 0.13% |
| RP_HPLC (TFA) Purity by Area Integration for: Impurity (RRT 0.29) | Report Result ≥0.1% | Injection #1 = 0.11%<br>Injection #2 = 0.09%<br>Mean = 0.10% |
| RP_HPLC (TFA) Purity by Area Integration for: Impurity (RRT 0.31) | Report Result ≥0.1% | Injection #1 = 0.07%<br>Injection #2 = 0.06%<br>Mean = 0.06% |
| RP_HPLC (TFA) Purity by Area Integration for: Impurity (RRT 0.32) | Report Result ≥0.1% | Injection #1 = 0.21%<br>Injection #2 = 0.20%<br>Mean = 0.20% |
| RP_HPLC (TFA) Purity by Area Integration for: Impurity (RRT 0.36) | Report Result ≥0.1% | Injection #1 = 0.14%<br>Injection #2 = 0.13%<br>Mean = 0.13% |
| RP_HPLC (TFA) Purity by Area Integration for: Impurity (RRT 0.39) | Report Result ≥0.1% | Injection #1 = 0.07%<br>Injection #2 = 0.08%<br>Mean = 0.08% |
| RP_HPLC (TFA) Purity by Area Integration for: Impurity (RRT 0.41) | Report Result ≥0.1% | Injection #1 = 0.13%<br>Injection #2 = 0.14%<br>Mean = 0.14% |
| RP_HPLC (TFA) Purity by Area Integration for: Impurity (RRT 0.47) | Report Result ≥0.1% | Injection #1 = 0.12%<br>Injection #2 = 0.14%<br>Mean = 0.13% |
| RP_HPLC (TFA) Purity by Area Integration for: Impurity (RRT 0.82) | Report Result ≥0.1% | Injection #1 = 0.35%<br>Injection #2 = 0.37%<br>Mean = 0.36% |
| RP_HPLC (TFA) Purity by Area Integration for: Impurity (RRT 0.87) | Report Result ≥0.1% | Injection #1 = 0.07%<br>Injection #2 = 0.07%<br>Mean = 0.07% |
| RP_HPLC (TFA) Purity by Area Integration for: Impurity (RRT 0.88) | Report Result ≥0.1% | Injection #1 = 0.37%<br>Injection #2 = 0.35%<br>Mean = 0.36% |
| RP_HPLC (TFA) Purity by Area Integration for: Impurity (RRT 0.91) | Report Result ≥0.1% | Injection #1 = 0.36%<br>Injection #2 = 0.35%<br>Mean = 0.36% |
| RP_HPLC (TFA) Purity by Area Integration for: Impurity (RRT 1.02) | Report Result ≥0.1% | Injection #1 = 0.21%<br>Injection #2 = 0.22%<br>Mean = 0.22% |
| RP_HPLC (TFA) Purity by Area Integration for: Impurity (RRT 1.04) | Report Result ≥0.1% | Injection #1 = 0.10%<br>Injection #2 = 0.10%<br>Mean = 0.10% |
| RP_HPLC (TFA) Purity by Area Integration for: Impurity (RRT 1.10) | Report Result ≥0.1% | Injection #1 = 0.08%<br>Injection #2 = 0.09%<br>Mean = 0.09% |

TABLE 15-continued

Results of analysis of sample 4.

| Test | Acceptance Criteria | Test Result(s) |
|---|---|---|
| RP_HPLC (TFA) Purity by Area Integration for: Impurity (RRT 1.11) | Report Result ≥0.1% | Injection #1 = 0.07%<br>Injection #2 = 0.08%<br>Mean = 0.07% |
| Total Impurities | Information | 3.6% |

TABLE 16

Results of analysis of sample 6.

| Test | Acceptance Criteria | Test Result(s) |
|---|---|---|
| Appearance | Upon thawing: Clear, colorless, particulate-free solution | Clear, colorless, particulate-free solution.<br>Meets acceptance criteria. |
| pH | 7.3 to 7.7 | 7.64<br>Meets acceptance criteria. |
| RP_HPLC (TFA) for Aileron peptide-1 Concentration | ≥13.5 mg/mL; ≤16.5 mg/mL | Injection #1 = 15.61 mg/mL<br>Injection #2 = 15.62 mg/mL<br>Mean = 15.6 mg/mL<br>Meets acceptance criteria. |
| RP_HPLC (TFA) Purity by Area Integration | ≥95% for Aileron peptide-1 peak | Injection #1 = 98.6%<br>Injection #2 = 98.6%<br>Mean = 98.6%<br>Meets acceptance criteria. |
| RP_HPLC (TFA) Purity by Area Integration for: Largest Impurity (RRT 0.91) | No single impurity >3% | Injection #1 = 0.43%<br>Injection #2 = 0.41%<br>Mean = 0.42%<br>Meets acceptance criteria. |
| RP_HPLC (TFA) Purity by Area Integration for: Largest Impurity (RRT 0.82) | Report Result ≥0.1% | Injection #1 = 0.10%<br>Injection #2 = 0.10%<br>Mean = 0.10% |
| RP_HPLC (TFA) Purity by Area Integration for: Largest Impurity (RRT 0.87) | Report Result ≥0.1% | Injection #1 = 0.08%<br>Injection #2 = 0.06%<br>Mean = 0.07% |
| RP_HPLC (TFA) Purity by Area Integration for: Largest Impurity (RRT 0.88) | Report Result ≥0.1% | Injection #1 = 0.39%<br>Injection #2 = 0.40%<br>Mean = 0.40% |
| RP_HPLC (TFA) Purity by Area Integration for: Largest Impurity (RRT 0.94) | Report Result ≥0.1% | Injection #1 = 0.08%<br>Injection #2 = 0.11%<br>Mean = 0.10% |
| RP_HPLC (TFA) Purity by Area Integration for: Largest Impurity (RRT 1.02) | Report Result ≥0.1% | Injection #1 = 0.15%<br>Injection #2 = 0.14%<br>Mean = 0.14% |
| RP_HPLC (TFA) Purity by Area Integration for: Largest Impurity (RRT 1.04) | Report Result ≥0.1% | Injection #1 = 0.06%<br>Injection #2 = 0.09%<br>Mean = 0.07% |
| RP_HPLC (TFA) Purity by Area Integration for: Largest Impurity (RRT 1.10) | Report Result ≥0.1% | Injection #1 = 0.07%<br>Injection #2 = 0.08%<br>Mean = 0.08% |
| Total Impurities | Information | 1.4% |

TABLE 17

Results of analysis of sample 7.

| Test | Acceptance Criteria | Test Result(s) |
|---|---|---|
| Appearance | Upon thawing: Clear, colorless, particulate-free solution | Clear, yellow, particulate-free solution.<br>Does not meet acceptance criteria. |
| pH | 7.3 to 7.7 | 7.45<br>Meets acceptance criteria. |
| RP_HPLC (TFA) for Aileron peptide-1 Concentration | ≥13.5 mg/mL; ≤16.5 mg/mL | Injection #1 = 14.09 mg/mL<br>Injection #2 = 14.05 mg/mL<br>Mean = 14.1 mg/mL<br>Meets acceptance criteria. |

TABLE 17-continued

Results of analysis of sample 7.

| Test | Acceptance Criteria | Test Result(s) |
|---|---|---|
| RP_HPLC (TFA) Purity by Area Integration | ≥95% for Aileron peptide-1 peak | Injection #1 = 94.3%<br>Injection #2 = 94.3%<br>Mean = 94.3%<br>Does not meet acceptance criteria. |
| RP_HPLC (TFA) Purity by Area Integration for: Largest Impurity (RRT 1.02) | No single impurity >3% | Injection #1 = 0.58%<br>Injection #2 = 0.59%<br>Mean = 0.59%<br>Meets acceptance criteria. |
| RP_HPLC (TFA) Purity by Area Integration for: Largest Impurity (RRT 0.11) | Report Result ≥0.1% | Injection #1 = 0.07%<br>Injection #2 = 0.07%<br>Mean = 0.07% |
| RP_HPLC (TFA) Purity by Area Integration for: Largest Impurity (RRT 0.12) | Report Result ≥0.1% | Injection #1 = 0.07%<br>Injection #2 = 0.07%<br>Mean = 0.07% |
| RP_HPLC (TFA) Purity by Area Integration for: Largest Impurity (RRT 0.16) | Report Result ≥0.1% | Injection #1 = 0.08%<br>Injection #2 = 0.08%<br>Mean = 0.08% |
| RP_HPLC (TFA) Purity by Area Integration for: Largest Impurity (RRT 0.19A) | Report Result ≥0.1% | Injection #1 = 0.39%<br>Injection #2 = 0.39%<br>Mean = 0.39% |
| RP_HPLC (TFA) Purity by Area Integration for: Largest Impurity (RRT 0.19B) | Report Result ≥0.1% | Injection #1 = 0.12%<br>Injection #2 = 0.12%<br>Mean = 0.12% |
| RP_HPLC (TFA) Purity by Area Integration for: Largest Impurity (RRT 0.20) | Report Result ≥0.1% | Injection #1 = 0.15%<br>Injection #2 = 0.15%<br>Mean = 0.15% |
| RP_HPLC (TFA) Purity by Area Integration for: Largest Impurity (RRT 0.23) | Report Result ≥0.1% | Injection #1 = 0.26%<br>Injection #2 = 0.26%<br>Mean = 0.26% |
| RP_HPLC (TFA) Purity by Area Integration for: Largest Impurity (RRT 0.24) | Report Result ≥0.1% | Injection #1 = 0.27%<br>Injection #2 = 0.27%<br>Mean = 0.27% |
| RP_HPLC (TFA) Purity by Area Integration for: Largest Impurity (RRT 0.25) | Report Result ≥0.1% | Injection #1 = 0.15%<br>Injection #2 = 0.14%<br>Mean = 0.14% |
| RP_HPLC (TFA) Purity by Area Integration for: Largest Impurity (RRT 0.28) | Report Result ≥0.1% | Injection #1 = 0.10%<br>Injection #2 = 0.09%<br>Mean = 0.09% |
| RP_HPLC (TFA) Purity by Area Integration for: Largest Impurity (RRT 0.29) | Report Result ≥0.1% | Injection #1 = 0.17%<br>Injection #2 = 0.18%<br>Mean = 0.17% |
| RP_HPLC (TFA) Purity by Area Integration for: Largest Impurity (RRT 0.32) | Report Result ≥0.1% | Injection #1 = 0.30%<br>Injection #2 = 0.30%<br>Mean = 0.30% |
| RP_HPLC (TFA) Purity by Area Integration for: Largest Impurity (RRT 0.36) | Report Result ≥0.1% | Injection #1 = 0.16%<br>Injection #2 = 0.15%<br>Mean = 0.16% |
| RP_HPLC (TFA) Purity by Area Integration for: Largest Impurity (RRT 0.41) | Report Result ≥0.1% | Injection #1 = 0.14%<br>Injection #2 = 0.14%<br>Mean = 0.14% |
| RP_HPLC (TFA) Purity by Area Integration for: Largest Impurity (RRT 0.43) | Report Result ≥0.1% | Injection #1 = 0.06%<br>Injection #2 = 0.06%<br>Mean = 0.06% |
| RP_HPLC (TFA) Purity by Area Integration for: Largest Impurity (RRT 0.47) | Report Result ≥0.1% | Injection #1 = 0.19%<br>Injection #2 = 0.18%<br>Mean = 0.18% |
| RP_HPLC (TFA) Purity by Area Integration for: Largest Impurity (RRT 0.74) | Report Result ≥0.1% | Injection #1 = 0.23%<br>Injection #2 = 0.23%<br>Mean = 0.23% |
| RP_HPLC (TFA) Purity by Area Integration for: Largest Impurity (RRT 0.82) | Report Result ≥0.1% | Injection #1 = 0.35%<br>Injection #2 = 0.36%<br>Mean = 0.35% |
| RP_HPLC (TFA) Purity by Area Integration for: Largest Impurity (RRT 0.83) | Report Result ≥0.1% | Injection #1 = 0.09%<br>Injection #2 = 0.09%<br>Mean = 0.09% |
| RP_HPLC (TFA) Purity by Area Integration for: Largest Impurity (RRT 0.87) | Report Result ≥0.1% | Injection #1 = 0.07%<br>Injection #2 = 0.06%<br>Mean = 0.07% |

TABLE 17-continued

Results of analysis of sample 7.

| Test | Acceptance Criteria | Test Result(s) |
|---|---|---|
| RP_HPLC (TFA) Purity by Area Integration for: Largest Impurity (RRT 0.88) | Report Result ≥0.1% | Injection #1 = 0.41% Injection #2 = 0.41% Mean = 0.41% |
| RP_HPLC (TFA) Purity by Area Integration for: Largest Impurity (RRT 0.91) | Report Result ≥0.1% | Injection #1 = 0.43% Injection #2 = 0.43% Mean = 0.43% |
| RP_HPLC (TFA) Purity by Area Integration for: Largest Impurity (RRT 0.96) | Report Result ≥0.1% | Injection #1 = 0.06% Injection #2 = 0.06% Mean = 0.06% |
| RP_HPLC (TFA) Purity by Area Integration for: Largest Impurity (RRT 1.04) | Report Result ≥0.1% | Injection #1 = 0.07% Injection #2 = 0.08% Mean = 0.07% |
| RP_HPLC (TFA) Purity by Area Integration for: Largest Impurity (RRT 0.96) | Report Result ≥0.1% | Injection #1 = 0.12% Injection #2 = 0.12% Mean = 0.12% |
| RP_HPLC (TFA) Purity by Area Integration for: Largest Impurity (RRT 1.11) | Report Result ≥0.1% | Injection #1 = 0.49% Injection #2 = 0.49% Mean = 0.49% |
| Total Impurities | Information | 5.6% |

Example 10: Von Heijne (VH) Value Calculation von Heijne values were calculated using a method adapted from Hessa et al., Recognition of transmembrane helices by the endoplasmic reticulum translocon, *Nature*: 433, 377-381 (2005). Briefly, each amino acid is assigned a fixed value, regardless of location along the polypeptide chain, according to the Table 18 below:

TABLE 18 von Heijne Score of various amino acids

| Amino Acid | von Heijne Score |
|---|---|
| I | −0.6 |
| L | −0.5 |
| Nle | −0.5 |
| $ | −0.5 |
| St | −0.5 |
| $e | −0.5 |
| $r8 | −0.5 |
| $r5 | −0.5 |
| $s8 | −0.5 |
| $s5 | −0.5 |
| $er8 | −0.5 |
| F | −0.3 |
| V | −0.3 |
| Aib | −0.1 |
| M | −0.1 |
| C | −0.1 |
| Abu | −0.1 |
| Ac— | 0 |
| —NH$_2$ | 0 |
| A | 0.1 |
| a | 0.1 |
| W | 0.3 |
| T | 0.5 |
| Y | 0.6 |
| G | 0.6 |
| S | 0.8 |
| N | 2 |
| H | 2 |
| P | 2.2 |
| Q | 2.2 |
| E | 2.5 |
| R | 2.5 |

TABLE 18-continued von Heijne Score of various amino acids

| Amino Acid | von Heijne Score |
|---|---|
| K | 2.5 |
| D | 3.5 |

The von Heijne value (VH) for the polypeptide is then calculated as the sum total of values for all amino acids in the polypeptide. For example, a pentapeptide of the sequence Ac-AAAAA-NH$_2$ (SEQ ID NO: 5) would have a VH score of 5*(0.1)=0.5.

Example 11: Reverse-Phase HPLC Retention Time Determination

Peptides were analyzed by reverse-phase HPLC on a 100×2.1 mm Phenomenex 2.6 micron, 100 Angstrom C18 column using the following mobile phase gradient at room temperature:

| Time (min) | Flow rate mL/min) | % A (0.1% TFA in water) | % B (0.1% TFA in acetonitrile) |
|---|---|---|---|
| 0 | 0.6 | 80 | 20 |
| 20.0 | 0.6 | 20 | 80 |
| 20.1 | 0.6 | 5 | 95 |
| 21.0 | 0.6 | 5 | 95 |
| 21.1 | 0.6 | 80 | 20 |
| 21.2 | 0.6 | 5 | 95 |
| 21.5 | 0.6 | 5 | 95 |
| 21.8 | 0.6 | 80 | 20 |
| 23.5 | 0.6 | 80 | 20 |

In some embodiments, the retention time (RT) was then normalized to a 0-100 scale by the following equation: RT=[RT_raw (from above)*3.317−0.534]*3.3333. In some embodiments, the retention times were not normalizd.

SEQUENCE LISTING (1697 sequences)

SEQ ID NO: 1 - protein, 15 aa, Artificial Sequence
  Description of Artificial Sequence: Synthetic peptide
MDVNPTLLFLKVPAQ

SEQ ID NO: 2 - protein, 11 aa, Artificial Sequence
  Description of Artificial Sequence: Synthetic peptide
MERIKELRNLM

SEQ ID NO: 3 - protein, 10 aa, Artificial Sequence
  Description of Artificial Sequence: Synthetic peptide
  MOD_RES (2)..(2): Any amino acid
  MOD_RES (9)..(9): Any amino acid
  see specification as filed for detailed description of substitutions and preferred embodiments
FXHYWAQLXS

SEQ ID NO: 4 - protein, 10 aa, Artificial Sequence
  Description of Artificial Sequence: Synthetic peptide
  MOD_RES (2)..(2): Any amino acid
  MOD_RES (8)..(8): Leu or Cyclobutyl-Ala
  MOD_RES (9)..(9): Any amino acid
  see specification as filed for detailed description of substitutions and preferred embodiments
FXEYWAQXXA

SEQ ID NO: 5 - protein, 5 aa, Artificial Sequence
  Description of Artificial Sequence: Synthetic peptide
AAAAA

SEQ ID NO: 6 - protein, 8 aa, Artificial Sequence
  Description of Artificial Sequence: Synthetic peptide
  MOD_RES (1)..(1): Any amino acid
  MOD_RES (5)..(5): Any amino acid
  MOD_RES (7)..(7): Lys or Ala
  MOD_RES (8)..(8): Val or Ala
XTLLXLXX

SEQ ID NO: 7 - protein, 8 aa, Artificial Sequence
  Description of Artificial Sequence: Synthetic peptide
  MOD_RES (1)..(1): Any amino acid
  MOD_RES (7)..(7): Lys or Ala
  MOD_RES (8)..(8): Any amino acid
XTLLFLXX

SEQ ID NO: 8 - protein, 2010 aa, Artificial Sequence
  Description of Artificial Sequence: Synthetic polypeptide
  MOD_RES (1)..(1001): Any amino acid
  MISC_FEATURE (1)..(1000): This region may encompass 1-1000 residues
  MOD_RES (1008)..(2010): Any amino acid
  MOD_RES (1009)..(2008): This region may encompass 0-1000 residues
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIGDAFNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 9 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAA

SEQ ID NO: 10 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (11)..(11): 2-aminoisobutyric acid
  C-term NH2
FAAYWEXLAAXA

SEQ ID NO: 11 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLASAL

SEQ ID NO: 12 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAL

SEQ ID NO: 13 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAM

SEQ ID NO: 14 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): hLeu
  C-term NH2
LTFAAYWAQLASAL

SEQ ID NO: 15 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAF

SEQ ID NO: 16 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAI

SEQ ID NO: 17 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Cyclohexyl-Gly
  C-term NH2
LTFAAYWAQLASAG

SEQ ID NO: 18 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLASAX

SEQ ID NO: 19 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 20 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(9): Crosslink between residues
  MOD_RES (9)..(9): Alpha-Me S5-pentenyl-alanine olefin amino acid connected by an all-carbon crosslinker comprising one double bond
  MOD_RES (11)..(11): Alpha-Me S5-pentenyl-alanine olefin amino acid connected by an all-carbon crosslinker comprising one double bond
  misc_feature (11)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): Norleucine
  C-term NH2
LTFAAYWAALASAL

SEQ ID NO: 21 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(9): Crosslink between residues
  MOD_RES (9)..(9): Alpha-Me S5-pentenyl-alanine olefin amino acid connected by an all-carbon crosslinker comprising one double bond
  MOD_RES (11)..(11): Alpha-Me S5-pentenyl-alanine olefin amino acid connected by an all-carbon crosslinker comprising one double bond
  misc_feature (11)..(13): Crosslink between residues
  MOD_RES (13)..(13): Alpha-Me S5-pentenyl-alanine olefin amino acid connected by an all-carbon crosslinker comprising one double bond
  C-term NH2
LTFAAYWAALASAA

SEQ ID NO: 22 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): Norleucine
  C-term NH2
FAAYWEXLAAAL

SEQ ID NO: 23 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAL

SEQ ID NO: 24 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAM

SEQ ID NO: 25 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): hLeu
  C-term NH2
FAAYWEXLAAAL

SEQ ID NO: 26 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAF

SEQ ID NO: 27 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAI

SEQ ID NO: 28 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): Cyclohexyl-Gly
  C-term NH2
FAAYWEXLAAAG

SEQ ID NO: 29 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): Cyclohexyl-Ala
  C-term NH2
FAAYWEXLAAAA

SEQ ID NO: 30 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): 2-aminoisobutyric acid
  C-term NH2
FAAYWEXLAAAX

SEQ ID NO: 31 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXV

SEQ ID NO: 32 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXV

SEQ ID NO: 33 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  C-term NH2
LTFAAYWAQLASXAA

SEQ ID NO: 34 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  C-term NH2
LTFAAYWAQLASXAA

SEQ ID NO: 35 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(16): Norleucine
  C-term NH2
HLTFAHHWHQLAAALL

SEQ ID NO: 36 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
DLTFAHHWHQLARRLV

SEQ ID NO: 37 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
HHTFAHHWHQLAAAML

SEQ ID NO: 38 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Cyclohexyl-Ala
  C-term NH2
FAHHWHQLARRDA

SEQ ID NO: 39 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHHWHQLAHRFV

SEQ ID NO: 40 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): hLeu
  C-term NH2
HLTFAHHWHQLAAALA

SEQ ID NO: 41 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Cyclohexyl-Gly
  MOD_RES (16)..(16): D-amino acid
  C-term NH2
DLTFAHHWHQLARRGL

SEQ ID NO: 42 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Cyclohexyl-Gly
  MOD_RES (16)..(16): D-amino acid
  C-term NH2
DLTFAHHWHQLARRGL

SEQ ID NO: 43 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Cyclohexyl-Ala
  MOD_RES (16)..(16): D-amino acid
  C-term NH2
HHTFAHHWHQLAAAAV

SEQ ID NO: 44 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAHHWHQLARRDA

SEQ ID NO: 45 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): 2-aminoisobutyric acid
  C-term NH2
FAHHWHQLAHRXG

SEQ ID NO: 46 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  C-term NH2
FAAYWAQLAHHLL

SEQ ID NO: 47 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Norleucine
  C-term NH2
FAAYWSALAHQAL

SEQ ID NO: 48 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Cyclohexyl-Gly
  MOD_RES (13)..(13): D-amino acid
  C-term NH2
FAAYWVQLAQHGL

SEQ ID NO: 49 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWTALAQQLV

SEQ ID NO: 50 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (11)..(11): 2-aminoisobutyric acid
  MOD_RES (13)..(13): D-amino acid
  C-term NH2
FAAYWYQLAHXAA

SEQ ID NO: 51 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAHHLA

SEQ ID NO: 52 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAHHLA

SEQ ID NO: 53 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAHQLV

SEQ ID NO: 54 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAHQLV

SEQ ID NO: 55 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAQQML

SEQ ID NO: 56 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAQQML

SEQ ID NO: 57 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (14)..(14): hLeu
  C-term NH2
LTFAAYWAQLAHXLV

SEQ ID NO: 58 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAHFA

SEQ ID NO: 59 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  MOD_RES (16)..(16): D-amino acid
  C-term NH2
HLTFAHHWHQLAAALL

SEQ ID NO: 60 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
DLTFAHHWHQLARRLA

SEQ ID NO: 61 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
HHTFAHHWHQLAAAMV

SEQ ID NO: 62 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHHWHQLARRDA

SEQ ID NO: 63 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Cyclohexyl-Ala
  C-term NH2
FAHHWHQLAHRFA

SEQ ID NO: 64 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHAm
FAAYWEALAAA

SEQ ID NO: 65 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHiAm
FAAYWEALAAA

SEQ ID NO: 66 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnPr3Ph
FAAYWEALAAA

SEQ ID NO: 67 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnBu33Me
FAAYWEALAAA

SEQ ID NO: 68 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnPr
FAAYWEALAAA

SEQ ID NO: 69 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnEt2Ch
FAAYWEALAAA

SEQ ID NO: 70 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnEt2Cp
FAAYWEALAAA

SEQ ID NO: 71 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHHex
FAAYWEALAAA

SEQ ID NO: 72 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAAIA

SEQ ID NO: 73 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAAIA

SEQ ID NO: 74 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAAAMA

SEQ ID NO: 75 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAAAMA

SEQ ID NO: 76 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 77 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 78 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIA

SEQ ID NO: 79 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIA

SEQ ID NO: 80 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAMA

SEQ ID NO: 81 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAMA

SEQ ID NO: 82 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALA

SEQ ID NO: 83 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALA

SEQ ID NO: 84 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIV

SEQ ID NO: 85 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIV

SEQ ID NO: 86 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAMV

SEQ ID NO: 87 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAALAAALV

SEQ ID NO: 88 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAALAAALV

SEQ ID NO: 89 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIL

SEQ ID NO: 90 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIL

SEQ ID NO: 91 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAML

SEQ ID NO: 92 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALL

SEQ ID NO: 93 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALL

SEQ ID NO: 94 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAAMA

SEQ ID NO: 95 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  C-term NH2
FAAYWEALAAALA

SEQ ID NO: 96 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAIA

SEQ ID NO: 97 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAMA

SEQ ID NO: 98 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALA

SEQ ID NO: 99 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAIV

SEQ ID NO: 100 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAMV

SEQ ID NO: 101 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALV

SEQ ID NO: 102 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAIL

SEQ ID NO: 103 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAML

SEQ ID NO: 104 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALL

SEQ ID NO: 105 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALL

SEQ ID NO: 106 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 107 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 108 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLAAVAA

SEQ ID NO: 109 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLAAVAA

SEQ ID NO: 110 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAAVA

SEQ ID NO: 111 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAAVA

SEQ ID NO: 112 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLASAAA

SEQ ID NO: 113 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLASAAA

SEQ ID NO: 114 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(16): D-amino acid
  C-term NH2
WTFAVYWSQLAAVAAA

SEQ ID NO: 115 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(16): D-amino acid
  C-term NH2
WTFAVYWSQLAAVAAA

SEQ ID NO: 116 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVG

SEQ ID NO: 117 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVG

SEQ ID NO: 118 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVQ

SEQ ID NO: 119 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVQ

SEQ ID NO: 120 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAAYWAQLASAA

SEQ ID NO: 121 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAAYWAQLASAA

SEQ ID NO: 122 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 123 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 124 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Two pentenyl-alanine olefin side chains, each of which is crosslinked to another amino acid as indicated
  misc_feature (11)..(14): Crosslink between residues
  MOD_RES (14)..(14): Alpha-Me S5-pentenyl-alanine olefin amino acid connected by an all-carbon crosslinker comprising one double bond
  C-term NH2
LTFAAYWEQLASAA

SEQ ID NO: 125 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASLA

SEQ ID NO: 126 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASLA

SEQ ID NO: 127 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASWA

SEQ ID NO: 128 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASWA

SEQ ID NO: 129 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASVS

SEQ ID NO: 130 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAS

SEQ ID NO: 131 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASVG

SEQ ID NO: 132 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
ETFAVYWAQLASAA

SEQ ID NO: 133 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASAA

SEQ ID NO: 134 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASVA

SEQ ID NO: 135 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASLA

SEQ ID NO: 136 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASWA

SEQ ID NO: 137 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAKYWAQLASWA

SEQ ID NO: 138 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASVS

SEQ ID NO: 139 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASAS

SEQ ID NO: 140 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASVG

SEQ ID NO: 141 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAVYWAQLASSA

SEQ ID NO: 142 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
ETFAVYWAQLASSA

SEQ ID NO: 143 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAVYWAQLASNA

SEQ ID NO: 144 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
ETFAVYWAQLASNA

SEQ ID NO: 145 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAVYWAQLASAA

SEQ ID NO: 146 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVA

SEQ ID NO: 147 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVA

SEQ ID NO: 148 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASWA

SEQ ID NO: 149 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVS

SEQ ID NO: 150 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVS

SEQ ID NO: 151 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASAS

SEQ ID NO: 152 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASAS

SEQ ID NO: 153 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVG

SEQ ID NO: 154 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVG

SEQ ID NO: 155 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 156 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 157 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me S5-pentenyl-alanine olefin amino acid connected by an all-carbon crosslinker comprising one double bond
  C-term NH2
LTFAEYWAQGASAA

SEQ ID NO: 158 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me S5-pentenyl-alanine olefin amino acid connected by an all-carbon crosslinker comprising one double bond
  C-term NH2
LTFAEYWAQGASAA

SEQ ID NO: 159 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQFASAA

SEQ ID NO: 160 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQFASAA

SEQ ID NO: 161 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 162 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 163 - protein, 14 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 164 - protein, 14 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 165 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 166 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 167 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 168 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 169 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWAQLASAA

SEQ ID NO: 170 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVQLASAA

SEQ ID NO: 171 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLASAA

SEQ ID NO: 172 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAQLASAA

SEQ ID NO: 173 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAQLASAA

SEQ ID NO: 174 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAQLASAA

SEQ ID NO: 175 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAQLASAA

SEQ ID NO: 176 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 177 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 178 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAHWAQLAAAIA

SEQ ID NO: 179 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAFYWAQLAAAIA

SEQ ID NO: 180 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEHWAQLAAAIA

SEQ ID NO: 181 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEHWAQLAAAIA

SEQ ID NO: 182 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ETFAEHWAQLAAAIA

SEQ ID NO: 183 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ETFAEHWAQLAAAIA

SEQ ID NO: 184 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAHWVQLAAAIA

SEQ ID NO: 185 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAFYWVQLAAAIA

SEQ ID NO: 186 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEYWVQLAAAIA

SEQ ID NO: 187 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEHWVQLAAAIA

SEQ ID NO: 188 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAEWAQLAAAIA

SEQ ID NO: 189 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAFWAQLAAAIA

SEQ ID NO: 190 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAFWAQLAAAIA

SEQ ID NO: 191 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLAAHFA

SEQ ID NO: 192 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAAHFA

SEQ ID NO: 193 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAAHFA

SEQ ID NO: 194 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFHWAQLAAEFA

SEQ ID NO: 195 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFHWAQLAAEFA

SEQ ID NO: 196 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAQLAAHFA

SEQ ID NO: 197 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAQLAAHFA

SEQ ID NO: 198 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWVQLAAHFA

SEQ ID NO: 199 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWVQLAAHFA

SEQ ID NO: 200 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEYWVQLAAHFA

SEQ ID NO: 201 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVQLAAHFA

SEQ ID NO: 202 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVQLAAHFA

SEQ ID NO: 203 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWAALASAA

SEQ ID NO: 204 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVALASAA

SEQ ID NO: 205 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAALASAA

SEQ ID NO: 206 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAALASAA

SEQ ID NO: 207 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAALASAA

SEQ ID NO: 208 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAALASAA

SEQ ID NO: 209 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAALASAA

SEQ ID NO: 210 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIA

SEQ ID NO: 211 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIA

SEQ ID NO: 212 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAAHFA

SEQ ID NO: 213 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAHIA

SEQ ID NO: 214 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAHIA

SEQ ID NO: 215 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAHWAQLAAHIA

SEQ ID NO: 216 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAHIA

SEQ ID NO: 217 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAFA

SEQ ID NO: 218 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAFA

SEQ ID NO: 219 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAWA

SEQ ID NO: 220 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAVA

SEQ ID NO: 221 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAVA

SEQ ID NO: 222 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAALA

SEQ ID NO: 223 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAALA

SEQ ID NO: 224 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAIA

SEQ ID NO: 225 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAIA

SEQ ID NO: 226 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAFA

SEQ ID NO: 227 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAFA

SEQ ID NO: 228 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAVA

SEQ ID NO: 229 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAVA

SEQ ID NO: 230 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAIA

SEQ ID NO: 231 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAIA

SEQ ID NO: 232 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAWA

SEQ ID NO: 233 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAWA

SEQ ID NO: 234 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAALA

SEQ ID NO: 235 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAALA

SEQ ID NO: 236 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ETFAEHWVQLAAALA

SEQ ID NO: 237 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAAA

SEQ ID NO: 238 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAAA

SEQ ID NO: 239 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXA

SEQ ID NO: 240 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXA

SEQ ID NO: 241 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAAYWAQLAAAAAA

SEQ ID NO: 242 - protein, 15 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  MOD_RES (15)..(15): D-amino acid
  C-term NH2
LTFAAYWAQLAAAIA

SEQ ID NO: 243 - protein, 14 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  C-term NH2
LTFAAYWAQLASAA

SEQ ID NO: 244 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAALA

SEQ ID NO: 245 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
ETFAAYWAQAAAALA

SEQ ID NO: 246 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAAAALA

SEQ ID NO: 247 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAWLA

SEQ ID NO: 248 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
ETFAAYWAQAAAWLA

SEQ ID NO: 249 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAAAWLA

SEQ ID NO: 250 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAFA

SEQ ID NO: 251 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAASALA

SEQ ID NO: 252 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 253 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWSQAASALA

SEQ ID NO: 254 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWWQAASALA

SEQ ID NO: 255 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAIA

SEQ ID NO: 256 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAIA

SEQ ID NO: 257 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 258 - protein, 14 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
ETFAEYWAQAASAA

SEQ ID NO: 259 - protein, 14 aa, Artificial Sequence
  Description of Artificial Sequence: Synthetic peptide
  N-term Ac
  MOD_RES (3)..(3): homo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 260 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYWAQAASAA

SEQ ID NO: 261 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYAAQAASAA

SEQ ID NO: 262 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 2-Naphthalanine
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYAAQAASAA

SEQ ID NO: 263 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAASAA

SEQ ID NO: 264 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAF

SEQ ID NO: 265 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAASAFA

SEQ ID NO: 266 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAASAF

SEQ ID NO: 267 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAASAF

SEQ ID NO: 268 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAFWAQAASAF

SEQ ID NO: 269 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAF

SEQ ID NO: 270 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWSQAASAF

SEQ ID NO: 271 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWWQAASAF

SEQ ID NO: 272 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAAAAIA

SEQ ID NO: 273 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAAAAIA

SEQ ID NO: 274 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAAAAIA

SEQ ID NO: 275 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAFWAQAAAAIA

SEQ ID NO: 276 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAFA

SEQ ID NO: 277 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAFA

SEQ ID NO: 278 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAAYWAQAAAWLA

SEQ ID NO: 279 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAEYWAQAAAWLA

SEQ ID NO: 280 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQAAAWLA

SEQ ID NO: 281 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQAAAWLA

SEQ ID NO: 282 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAASAFA

SEQ ID NO: 283 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAASAFA

SEQ ID NO: 284 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAAYWAQLAAWLA

SEQ ID NO: 285 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAEYWAQLAAWLA

SEQ ID NO: 286 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQLAAWLA

SEQ ID NO: 287 - protein, 14 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 288 - protein, 14 aa, Artificial Sequence
  Description of Artificial Sequence: Synthetic peptide
  N-term Hexac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 289 - protein, 14 aa, Artificial Sequence
  Description of Artificial Sequence: Synthetic peptide
  N-term Napac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 290 - protein, 14 aa, Artificial Sequence
  Description of Artificial Sequence: Synthetic peptide
  N-term Decac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 291 - protein, 14 aa, Artificial Sequence
  Description of Artificial Sequence: Synthetic peptide
  N-term Admac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 292 - protein, 14 aa, Artificial Sequence
  Description of Artificial Sequence: Synthetic peptide
  N-term Tmac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 293 - protein, 14 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 294 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAALA

SEQ ID NO: 295 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAIA

SEQ ID NO: 296 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 297 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 298 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 299 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 300 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWSQAASAA

SEQ ID NO: 301 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWSQAASAA

SEQ ID NO: 302 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 303 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAF

SEQ ID NO: 304 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAF

SEQ ID NO: 305 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 306 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 307 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 308 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 309 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWSQLASAA

SEQ ID NO: 310 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWSQLASAA

SEQ ID NO: 311 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALA

SEQ ID NO: 312 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 313 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAFWAQLAAALA

SEQ ID NO: 314 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWSQLAAALA

SEQ ID NO: 315 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 316 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 317 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAFWAQLAAALA

SEQ ID NO: 318 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAFWAQLAAALA

SEQ ID NO: 319 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWSQLAAALA

SEQ ID NO: 320 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWSQLAAALA

SEQ ID NO: 321 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAAYWAQLAAAAAA

SEQ ID NO: 322 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAAYWAQLAAAAAA

SEQ ID NO: 323 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 324 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAAYWAQLAAAAAAAA

SEQ ID NO: 325 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAAYWAQLAAAAAAAA

SEQ ID NO: 326 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALA

SEQ ID NO: 327 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
AATFAAYWAQLAAALA

SEQ ID NO: 328 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALAA

SEQ ID NO: 329 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAAYWAQLAAALAA

SEQ ID NO: 330 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAALAA

SEQ ID NO: 331 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALAA

SEQ ID NO: 332 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAA

SEQ ID NO: 333 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAA

SEQ ID NO: 334 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAAA

SEQ ID NO: 335 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAAA

SEQ ID NO: 336 - protein, 15 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 337 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAAA

SEQ ID NO: 338 - protein, 15 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 339 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 340 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 341 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 342 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 343 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 344 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 345 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 346 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 347 - protein, 16 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(4): Crosslink between residues
  MOD_RES (5)..(5): 6cl-Trp
  MOD_RES (16)..(16): D-amino acid
  C-term NH2
FAAYWEALAAAAAAAA

SEQ ID NO: 348 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
ETFAEYWAQLAAAAAAA

SEQ ID NO: 349 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
ETFAEYWAQLAAAAAAA

SEQ ID NO: 350 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAEYWAQLAAAAAAAA

SEQ ID NO: 351 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAEYWAQLAAAAAAAA

SEQ ID NO: 352 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAAYWAQLAAALAAA

SEQ ID NO: 353 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAAYWAQLAAALAAA

SEQ ID NO: 354 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 355 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 356 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQAAAAAAAA

SEQ ID NO: 357 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQAAAAAAAA

SEQ ID NO: 358 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWSQAAAAAAAA

SEQ ID NO: 359 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWSQAAAAAAAA

SEQ ID NO: 360 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAASAAA

SEQ ID NO: 361 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAASAAA

SEQ ID NO: 362 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
ALTFAEYWAQAASAAA

SEQ ID NO: 363 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
ALTFAEYWAQAASAAA

SEQ ID NO: 364 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (17)..(17): D-amino acid
  C-term NH2
ALTFAEYWAQAASAAAA

SEQ ID NO: 365 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (17)..(17): D-amino acid
  C-term NH2
ALTFAEYWAQAASAAAA

SEQ ID NO: 366 - protein, 18 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): Cyclobutyl-Ala
  MOD_RES (13)..(13): Alpha-Me S5-pentenyl-alanine olefin amino acid connected by an all-carbon crosslinker comprising one double bond
  MOD_RES (18)..(18): D-amino acid
  C-term NH2
AALTFAEYWAQAASAAAA

SEQ ID NO: 367 - protein, 18 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): Cyclobutyl-Ala
  MOD_RES (13)..(13): Alpha-Me S5-pentenyl-alanine olefin amino acid connected by an all-carbon crosslinker comprising one double bond
  MOD_RES (18)..(18): D-amino acid
  C-term NH2
AALTFAEYWAQAASAAAA

SEQ ID NO: 368 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
RTFAEYWAQAASAA

SEQ ID NO: 369 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LRFAEYWAQAASAA

SEQ ID NO: 370 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWRQAASAA

SEQ ID NO: 371 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWARAASAA

SEQ ID NO: 372 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAARAA

SEQ ID NO: 373 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASRA

SEQ ID NO: 374 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAR

SEQ ID NO: 375 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 376 - protein, 16 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAAYWAQLAAALA

SEQ ID NO: 377 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LAFAEYWAQLAAALA

SEQ ID NO: 378 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
ATFAEYWAQLAAALA

SEQ ID NO: 379 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
AAFAEYWAQLAAALA

SEQ ID NO: 380 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
AAAFAEYWAQLAAALA

SEQ ID NO: 381 - protein, 17 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Norleucine
  C-term NH2
AAAAFAEYWAQLAAALA

SEQ ID NO: 382 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
AATFAEYWAQLAAALA

SEQ ID NO: 383 - protein, 17 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Norleucine
  C-term NH2
AALTFAEYWAQLAAALA

SEQ ID NO: 384 - protein, 18 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  MOD_RES (17)..(17): Norleucine
  C-term NH2
AAALTFAEYWAQLAAALA

SEQ ID NO: 385 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALAA

SEQ ID NO: 386 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAEYWAQLAAALAA

SEQ ID NO: 387 - protein, 18 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Norleucine
  C-term NH2
AALTFAEYWAQLAAALAA

SEQ ID NO: 388 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAAAALAA

SEQ ID NO: 389 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALAA

SEQ ID NO: 390 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): hLeu
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAEYWAQLAAALAA

SEQ ID NO: 391 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): N-methyl-Tyr
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 392 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): N-methyl-Tyr
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 393 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): N-methyl-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 394 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): N-methyl-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 395 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): Alpha-Me-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 396 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): Alpha-Me-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 397 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWXQLAAALA

SEQ ID NO: 398 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWXQLAAALA

SEQ ID NO: 399 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (14)..(14): Norleucine
  C-term NH2
LTFAAYWAQLAAXLA

SEQ ID NO: 400 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (14)..(14): Norleucine
  C-term NH2
LTFAAYWAQLAAXLA

SEQ ID NO: 401 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  MOD_RES (14)..(14): Norleucine
  C-term NH2
LTFAAYWAQLAAALA

SEQ ID NO: 402 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  MOD_RES (14)..(14): Norleucine
  C-term NH2
LTFAAYWAQLAAALA

SEQ ID NO: 403 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Sarcosine
  MOD_RES (14)..(14): Norleucine
  C-term NH2
LTFAAYWAQLAAXLA

SEQ ID NO: 404 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Sarcosine
  MOD_RES (14)..(14): Norleucine
  C-term NH2
LTFAAYWAQLAAXLA

SEQ ID NO: 405 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): 2-aminoisobutyric acid
  C-term NH2
LTFAAYWAQLAAALX

SEQ ID NO: 406 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): 2-aminoisobutyric acid
  C-term NH2
LTFAAYWAQLAAALX

SEQ ID NO: 407 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): N-methyl-Ala
  C-term NH2
LTFAAYWAQLAAALA

SEQ ID NO: 408 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): N-methyl-Ala
  C-term NH2
LTFAAYWAQLAAALA

SEQ ID NO: 409 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): Sarcosine
  C-term NH2
LTFAAYWAQLAAALX

SEQ ID NO: 410 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): Sarcosine
  C-term NH2
LTFAAYWAQLAAALX

SEQ ID NO: 411 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): 2-aminoisobutyric acid
  C-term NH2
LTFAAYWAQLAAALAX

SEQ ID NO: 412 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): 2-aminoisobutyric acid
  C-term NH2
LTFAAYWAQLAAALAX

SEQ ID NO: 413 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): N-methyl-Ala
  C-term NH2
LTFAAYWAQLAAALAA

SEQ ID NO: 414 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): N-methyl-Ala
  C-term NH2
LTFAAYWAQLAAALAA

SEQ ID NO: 415 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): D-amino acid
  C-term NH2
LTFAAYWAQLAAALAA

SEQ ID NO: 416 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): D-amino acid
  C-term NH2
LTFAAYWAQLAAALAA

SEQ ID NO: 417 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): Sarcosine
  C-term NH2
LTFAAYWAQLAAALAX

SEQ ID NO: 418 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): Sarcosine
  C-term NH2
LTFAAYWAQLAAALAX

SEQ ID NO: 419 - protein, 15 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  MOD_RES (14)..(14): Norleucine
  C-term NH2
LTFAAYWAQLAAALA

SEQ ID NO: 420 - protein, 15 aa, Artificial Sequence
  Description of Artificial Sequence: Synthetic peptide
  N-term Ac
  MOD_RES (4)..(4): 2-aminoisobutyric acid
  MOD_RES (11)..(11): 2-aminoisobutyric acid
  MOD_RES (14)..(14): Norleucine
  C-term NH2
LTFXAYWAQLXAALA

SEQ ID NO: 421 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou4
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAXYWAQLAAALA

SEQ ID NO: 422 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou4
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAXYWAQLAAALA

SEQ ID NO: 423 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou4
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWXQLAAALA

SEQ ID NO: 424 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Cou4
  MOD_RES (14)..(14): Norleucine
  C-term NH2
LTFAAYWAQLAXALA

SEQ ID NO: 425 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Cou4
  MOD_RES (14)..(14): Norleucine
  C-term NH2
LTFAAYWAQLAXALA

SEQ ID NO: 426 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Cou4
  MOD_RES (14)..(14): Norleucine
  C-term NH2
LTFAAYWAQLAAXLA

SEQ ID NO: 427 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Cou4
  MOD_RES (14)..(14): Norleucine
  C-term NH2
LTFAAYWAQLAAXLA

SEQ ID NO: 428 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term OH
LTFAAYWAQLAAALA

SEQ ID NO: 429 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term OH
LTFAAYWAQLAAALA

SEQ ID NO: 430 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnPr
LTFAAYWAQLAAALA

SEQ ID NO: 431 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnPr
LTFAAYWAQLAAALA

SEQ ID NO: 432 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnBu33Me
LTFAAYWAQLAAALA

SEQ ID NO: 433 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnBu33Me
LTFAAYWAQLAAALA

SEQ ID NO: 434 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHHex
LTFAAYWAQLAAALA

SEQ ID NO: 435 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHHex
LTFAAYWAQLAAALA

SEQ ID NO: 436 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTAAAYWAQLAAALA

SEQ ID NO: 437 - protein, 15 aa, Artificial Sequence
  Description of Artificial Sequence: Synthetic peptide
  N-term Ac
  MOD_RES (3)..(3): hLeu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTLAAYWAQLAAALA

SEQ ID NO: 438 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYAAQLAAALA

SEQ ID NO: 439 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 2-Naphthalanine
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYAAQLAAALA

SEQ ID NO: 440 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou4
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWXQAASAA

SEQ ID NO: 441 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWXQAASAA

SEQ ID NO: 442 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon saturated crosslinker comprising no double bonds
  C-term NH2
LTFAEYWAQAASAA

SEQ ID NO: 443 - protein, 14 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 444 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 445 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 446 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 447 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 448 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 449 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 450 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 451 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 452 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  MOD_RES (14)..(14): Norleucine
  C-term NH2
LTFAAYWAQLAAALA

SEQ ID NO: 453 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  MOD_RES (17)..(17): D-amino acid
  C-term NH2
LTFAEYWAQLAAAAAAA

SEQ ID NO: 454 - protein, 16 aa, Artificial Sequence
  Description of Artificial Sequence: Synthetic peptide
  MOD_RES (1)..(1): Cou6
  MOD_RES (2)..(2): Beta-Ala
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): hLeu
  MOD_RES (13)..(13): Alpha-Me S5-pentenyl-alanine olefin amino acid connected by an all-carbon crosslinker comprising one double bond
  C-term NH2
XALTFAEYWAQLASAA

SEQ ID NO: 455 - protein, 16 aa, Artificial Sequence
  Description of Artificial Sequence: Synthetic peptide
  MOD_RES (1)..(1): Cou8
  MOD_RES (2)..(2): Beta-Ala
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): hLeu
  MOD_RES (13)..(13): Alpha-Me S5-pentenyl-alanine olefin amino acid connected by an all-carbon crosslinker comprising one double bond
  C-term NH2
XALTFAEYWAQLASAA

SEQ ID NO: 456 - protein, 17 aa, Artificial Sequence
  Description of Artificial Sequence: Synthetic peptide
  N-term Ac
  MOD_RES (3)..(3): 4-iodo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 457 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 458 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAQLAAAAAAA

SEQ ID NO: 459 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAQLAAAAAAA

SEQ ID NO: 460 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAELAAAAAAA

SEQ ID NO: 461 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAELAAAAAAA

SEQ ID NO: 462 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAELAAAAAAA

SEQ ID NO: 463 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 464 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQLAAAAAAA

SEQ ID NO: 465 - protein, 20 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  MOD_RES (20)..(20): D-amino acid
  C-term NH2
AAALTFAEYWAQLAAAAAAA

SEQ ID NO: 466 - protein, 17 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 467 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
RTFAEYWAQLAAAAAAA

SEQ ID NO: 468 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAEYWAQLAAAAAAA

SEQ ID NO: 469 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWXQLAAAAAAA

SEQ ID NO: 470 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (17)..(17): D-amino acid
  C-term NH2
LTFAEYWAQLAAXAAAA

SEQ ID NO: 471 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  MOD_RES (17)..(17): D-amino acid
  C-term NH2
LTFAEYWAQLAAAXAAA

SEQ ID NO: 472 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): 2-aminoisobutyric acid
  MOD_RES (17)..(17): D-amino acid
  C-term NH2
LTFAEYWAQLAAAAXAA

SEQ ID NO: 473 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): D-amino acid
  C-term NH2
LTFAEYWAQLAAAAAXA

SEQ ID NO: 474 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): D-amino acid
  C-term NH2
LTFAEYWAQLAAAAAXA

SEQ ID NO: 475 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): 2-aminoisobutyric acid
  C-term NH2
LTFAEYWAQLAAAAAAX

SEQ ID NO: 476 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  MOD_RES (17)..(17): D-amino acid
  C-term NH2
LTFAEYWAQLAAAAAAA

SEQ ID NO: 477 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  MOD_RES (17)..(17): D-amino acid
  C-term NH2
LTFAEYWAQLAAAAAAA

SEQ ID NO: 478 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  MOD_RES (17)..(17): D-amino acid
  C-term NH2
LTFAEYWAQLAAAAAAA

SEQ ID NO: 479 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  MOD_RES (17)..(17): D-amino acid
  C-term NH2
LTFAEYWAQLAAAAAAA

SEQ ID NO: 480 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(17): D-amino acid
  C-term NH2
LTFAEYWAQLAAAAAAA

SEQ ID NO: 481 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAAAAAAA

SEQ ID NO: 482 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Sarcosine
  MOD_RES (17)..(17): D-amino acid
  C-term NH2
LTFAEYWAQLAAXAAAA

SEQ ID NO: 483 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Sarcosine
  MOD_RES (17)..(17): D-amino acid
  C-term NH2
LTFAEYWAQLAAAXAAA

SEQ ID NO: 484 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): Sarcosine
  MOD_RES (17)..(17): D-amino acid
  C-term NH2
LTFAEYWAQLAAAAXAA

SEQ ID NO: 485 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): Sarcosine
  MOD_RES (17)..(17): D-amino acid
  C-term NH2
LTFAEYWAQLAAAAAXA

SEQ ID NO: 486 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): Sarcosine
  C-term NH2
LTFAEYWAQLAAAAAAX

SEQ ID NO: 487 - protein, 17 aa, Artificial Sequence
  Description of Artificial Sequence: Synthetic peptide
  N-term Ac
  MOD_RES (1)..(1): N15 isotopic-Leu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 488 - protein, 16 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  MOD_RES (16)..(16): D-amino acid
  C-term NH2
TFAEYWAQLAAAAAAA

SEQ ID NO: 489 - protein, 15 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (15)..(15): D-amino acid
  C-term NH2
FAEYWAQLAAAAAAA

SEQ ID NO: 490 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LVFAEYWAQLAAAAAAA

SEQ ID NO: 491 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
AAFAEYWAQLAAAAAAA

SEQ ID NO: 492 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAEYWAQLAAAAAA

SEQ ID NO: 493 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAAA

SEQ ID NO: 494 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAEYWAQLAAAA

SEQ ID NO: 495 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  C-term NH2
LTFAEYWAQLAAA

SEQ ID NO: 496 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAEYWAQLAA

SEQ ID NO: 497 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAAA

SEQ ID NO: 498 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAA

SEQ ID NO: 499 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAAAA

SEQ ID NO: 500 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWAQAASAA

SEQ ID NO: 501 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWAQAAS

SEQ ID NO: 502 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAAS

SEQ ID NO: 503 - protein, 17 aa, Artificial Sequence
  Description of Artificial Sequence: Synthetic peptide
  N-term 4FBzl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 504 - protein, 14 aa, Artificial Sequence
  Description of Artificial Sequence: Synthetic peptide
  N-term 4FBzl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 505 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFARYWAQLAAAAAAA

SEQ ID NO: 506 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAHYWAQLAAAAAAA

SEQ ID NO: 507 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAQYWAQLAAAAAAA

SEQ ID NO: 508 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cit
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAXYWAQLAAAAAAA

SEQ ID NO: 509 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(13): Crosslink between residues
  MOD_RES (6)..(7): D-amino acid
  MOD_RES (13)..(13): Alpha-Me S5-pentenyl-alanine olefin amino acid connected by an all-carbon crosslinker comprising one double bond
  MOD_RES (19)..(19): D-amino acid
  C-term NH2
LTFAELAYWAQLAAAAAAA

SEQ ID NO: 510 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(12): Crosslink between residues
  MOD_RES (5)..(5): Phe-4
  MOD_RES (6)..(6): D-amino acid
  MOD_RES (12)..(121): Alpha-Me S5-pentenyl-alanine olefin amino acid connected by an all-carbon crosslinker comprising one double bond
  MOD_RES (18)..(18): D-amino acid
  C-term NH2
LTFAFGYWAQLAAAAAAA

SEQ ID NO: 511 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): 2m-Arg
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFARYWAQLAAAAAAA

SEQ ID NO: 512 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): ip-Lys
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAKYWAQLAAAAAAA

SEQ ID NO: 513 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Phe-4NH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAFYWAQLAAAAAAA

SEQ ID NO: 514 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAALAAAAAAA

SEQ ID NO: 515 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWALLAAAAAAA

SEQ ID NO: 516 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): 2-aminoisobutyric acid
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAXLAAAAAAA

SEQ ID NO: 517 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWASLAAAAAAA

SEQ ID NO: 518 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWANLAAAAAAA

SEQ ID NO: 519 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Cit
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAXLAAAAAAA

SEQ ID NO: 520 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAHLAAAAAAA

SEQ ID NO: 521 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWARLAAAAAAA

SEQ ID NO: 522 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  MOD_RES (6)..(6): pTyr
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 523 - protein, 14 aa, Artificial Sequence
  Description of Artificial Sequence: Synthetic peptide
  N-term Cbm
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 524 - protein, 17 aa, Artificial Sequence
  Description of Artificial Sequence: Synthetic peptide
  N-term Cbm
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 525 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLASAAAAA

SEQ ID NO: 526 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAASA

SEQ ID NO: 527 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLASAAASA

SEQ ID NO: 528 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(12): Crosslink between residues
  MOD_RES (11)..(11): Beta-Ala
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
LTFAEYWAQTAAAAAAAA

SEQ ID NO: 529 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQGAAAAAAA

SEQ ID NO: 530 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 531 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-cyclohexyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 532 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQFAAAAAAA

SEQ ID NO: 533 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-Phe
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQFAAAAAAA

SEQ ID NO: 534 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAEYWAQLAAALAAA

SEQ ID NO: 535 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAEYWAQGAAALAAA

SEQ ID NO: 536 - protein, 18 aa, Artificial Sequence
  Description of Artificial Sequence: Synthetic peptide
  N-term 4FBz
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 537 - protein, 15 aa, Artificial Sequence
  Description of Artificial Sequence: Synthetic peptide
  N-term 4FBz
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 538 - protein, 17 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 539 - protein, 14 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S8-octenyl-alanine olefin amino acid connected by an all-carbon crosslinker comprising one double bond
  C-term NH2
LTFAEYWAQAASAA

SEQ ID NO: 540 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): hhLeu
  MOD_RES (17)..(17): D-amino acid
  C-term NH2
LTFAEYWAQLAAALAAA

SEQ ID NO: 541 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (19)..(19): D-amino acid
  C-term NH2
LTFAEYWAQLAAAAAAAAA

SEQ ID NO: 542 - protein, 20 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (20)..(20): D-amino acid
  C-term NH2
LTFAEYWAQLAAAAAAAAAA

SEQ ID NO: 543 - protein, 21 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (21)..(21): D-amino acid
  C-term NH2
LTFAEYWAQLAAAAAAAAAAA

SEQ ID NO: 544 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYAAQAASAA

SEQ ID NO: 545 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAEYAAQLAAAAAAA

SEQ ID NO: 546 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Pmp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEXWAQLAAAAAAA

SEQ ID NO: 547 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Pmp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEXWAQAASAA

SEQ ID NO: 548 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAHYWAQLAS

SEQ ID NO: 549 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 550 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 551 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASA

SEQ ID NO: 552 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 553 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAASAA

SEQ ID NO: 554 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFASYWAQAASAA

SEQ ID NO: 555 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFARYWAQAASAA

SEQ ID NO: 556 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAKYWAQAASAA

SEQ ID NO: 557 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAQYWAQAASAA

SEQ ID NO: 558 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAAAASAA

SEQ ID NO: 559 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAAAAA

SEQ ID NO: 560 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAAAAA

SEQ ID NO: 561 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAAAA

SEQ ID NO: 562 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAA

SEQ ID NO: 563 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAFWAQLAAAAAAA

SEQ ID NO: 564 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAFWAALAAAAAAA

SEQ ID NO: 565 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 566 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): pY
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 567 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): pY
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAALAAAAAAA

SEQ ID NO: 568 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): pY
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 569 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAAYWAQLAAAAAAA

SEQ ID NO: 570 - protein, 14 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (10)..(10): Cyclobutyl-Ala
  MOD_RES (11)..(11): Alpha-Me S5-pentynyl-alanine alkynyl amino acids, wherein the alkyne forms one half of a dialkyne bond with a second alkynyl amino acid
  C-term NH2
LTFAEYWAQAASAA

SEQ ID NO: 571 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAEYWAQLAAAAAAA

SEQ ID NO: 572 - protein, 17 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (11)..(11): Alpha-Me S6-hexynyl-alanine alkynyl amino acid crosslinked via an alkyne metathesis reaction with a second alkynyl amino acid
  MOD_RES (17)..(17): D-amino acid
  C-term NH2
LTFAEYWAQLAAAAAAA

SEQ ID NO: 573 - protein, 17 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (11)..(11): Alpha-Me S6-hexynyl-alanine alkynyl amino acid crosslinked via an alkyne metathesis reaction with a second alkynyl amino acid
  MOD_RES (17)..(17): D-amino acid
  C-term NH2
LTFAEYWAQLAAAAAAA

SEQ ID NO: 574 - protein, 14 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (10)..(10): Cyclobutyl-Ala
  MOD_RES (11)..(11): Alpha-Me S6-hexynyl-alanine alkynyl amino acid crosslinked via an alkyne metathesis reaction with a second alkynyl amino acid
  C-term NH2
LTFAEYWAQAASAA

SEQ ID NO: 575 - protein, 14 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (10)..(10): Cyclobutyl-Ala
  MOD_RES (11)..(11): Alpha-Me S6-hexynyl-alanine alkynyl amino acid crosslinked via an alkyne metathesis reaction with a second alkynyl amino acid
  C-term NH2
LTAAEYWAQAASAA

SEQ ID NO: 576 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R9-nonynyl-alanine alkynyl amino acid crosslinked via an alkyne metathesis reaction with a second alkynyl amino acid
  misc_feature (5)..(12): Crosslink between residues
  MOD_RES (11)..(11): Cyclobutyl-Ala
  MOD_RES (12)..(12): Alpha-Me S6-hexynyl-alanine alkynyl amino acid crosslinked via an alkyne metathesis reaction with a second alkynyl amino acid
  C-term NH2
ALTFAEYWAQAASAA

SEQ ID NO: 577 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 578 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid that is not connected by a crosslinker
  MOD_RES (12)..(12): Alpha-Me S5-pentenyl-alanine olefin amino acid that is not connected by a crosslinker
  MOD_RES (18)..(18): D-amino acid
  C-term NH2
ALTFAEYWAQLAAAAAAA

SEQ ID NO: 579 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTAAEYWAQLAAAAAAA

SEQ ID NO: 580 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAAYWAQLAAAAAAA

SEQ ID NO: 581 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
AATFAEYWAQLAAAAAAA

SEQ ID NO: 582 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALAFAEYWAQLAAAAAAA

SEQ ID NO: 583 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEAWAQLAAAAAAA

SEQ ID NO: 584 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYAAQLAAAAAAA

SEQ ID NO: 585 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTAAEYAAQLAAAAAAA

SEQ ID NO: 586 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAALAAAAAAA

SEQ ID NO: 587 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQAAAAAAAA

SEQ ID NO: 588 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid that is not connected by a crosslinker
  MOD_RES (11)..(11): Cyclobutyl-Ala
  MOD_RES (12)..(12): Alpha-Me S5-pentenyl-alanine olefin amino acid that is not connected by a crosslinker
  C-term NH2
ALTFAEYWAQAASAA

SEQ ID NO: 589 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYWAQAASAA

SEQ ID NO: 590 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYAAQAASAA

SEQ ID NO: 591 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYAAQAASAA

SEQ ID NO: 592 - protein, 17 aa, Artificial Sequence
  Description of Artificial Sequence: Synthetic peptide
  N-term 5-FAM
  MOD_RES (1)..(1): Beta-Ala
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
  C-term NH2
AQSQQTFANLWRLLAQN

SEQ ID NO: 593 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 594 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYWAQAASAA

SEQ ID NO: 595 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYAAQAASAA

SEQ ID NO: 596 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYAAQAASAA

SEQ ID NO: 597 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid that is not connected by a crosslinker
  MOD_RES (11)..(11): Cyclobutyl-Ala
  MOD_RES (12)..(12): Alpha-Me S5-pentenyl-alanine olefin amino acid that is not connected by a crosslinker
  C-term NH2
ALTFAEYWAQAASAA

SEQ ID NO: 598 - protein, 18 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 599 - protein, 18 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTAAEYWAQLAAAAAAA

SEQ ID NO: 600 - protein, 18 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid that is not connected by a crosslinker
  MOD_RES (12)..(12): Alpha-Me S5-pentenyl-alanine olefin amino acid that is not connected by a crosslinker
  MOD_RES (18)..(18): D-amino acid
  C-term NH2
ALTFAEYWAQLAAAAAAA

SEQ ID NO: 601 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWXQAASAA

SEQ ID NO: 602 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWXQAAS

SEQ ID NO: 603 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYWXQAASAA

SEQ ID NO: 604 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYAXQAASAA

SEQ ID NO: 605 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYAXQAASAA

SEQ ID NO: 606 - protein, 14 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (8)..(8): Cou7
  MOD_RES (10)..(10): Cyclobutyl-Ala
  MOD_RES (11)..(11): Alpha-Me S5-pentenyl-alanine olefin amino acid that is not connected by a crosslinker
  C-term NH2
LTFAEYWXQAASAA

SEQ ID NO: 607 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWXQLAAAAAAA

SEQ ID NO: 608 - protein, 17 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (8)..(8): Cou7
  MOD_RES (11)..(11): Alpha-Me S5-pentenyl-alanine olefin amino acid that is not connected by a crosslinker
  MOD_RES (17)..(17): D-amino acid
  C-term NH2
LTFAEYWXQLAAAAAAA

SEQ ID NO: 609 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAAAAA

SEQ ID NO: 610 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAAAA

SEQ ID NO: 611 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAAA

SEQ ID NO: 612 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAA

SEQ ID NO: 613 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAA

SEQ ID NO: 614 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAASA

SEQ ID NO: 615 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAALAAAAAAA

SEQ ID NO: 616 - protein, 18 aa, Artificial Sequence
  Description of Artificial Sequence: Synthetic peptide
  N-term Biotin
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 617 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 618 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASA

SEQ ID NO: 619 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAASAA

SEQ ID NO: 620 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFASYWAQAASAA

SEQ ID NO: 621 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFARYWAQAASAA

SEQ ID NO: 622 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAKYWAQAASAA

SEQ ID NO: 623 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAAAAA

SEQ ID NO: 624 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  MOD_RES (18)..(18): Beta-Ala
  C-term NH2
LTFAEYWAQLAAAAAAAAC

SEQ ID NO: 625 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(18): D-amino acid
  MOD_RES (19)..(19): Peg4C
  C-term NH2
LTFAEYWAQLAAAAAAADC

SEQ ID NO: 626 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAAYWAALAAAAAAA

SEQ ID NO: 627 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAALAAAAAAA

SEQ ID NO: 628 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAAYWAALAAAAAAA

SEQ ID NO: 629 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAAYWAQLAAAAAAA

SEQ ID NO: 630 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAQLAAAAAAA

SEQ ID NO: 631 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAAYWAALAAAAAAA

SEQ ID NO: 632 - protein, 18 aa, Artificial Sequence
  Description of Artificial Sequence: Synthetic peptide
  N-term FITC
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 633 - protein, 15 aa, Artificial Sequence
  Description of Artificial Sequence: Synthetic peptide
  N-term FITC
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 634 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAEAAAAA

SEQ ID NO: 635 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAEAAAAA

SEQ ID NO: 636 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  MOD_RES (18)..(18): Beta-Ala
  MOD_RES (19)..(19): Lys-bio
  C-term NH2
LTFAEYWAQLAAAAAAAAK

SEQ ID NO: 637 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAALAAAAAAA

SEQ ID NO: 638 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAALAAAAAAA

SEQ ID NO: 639 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAQLAAAAAAA

SEQ ID NO: 640 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAEAAAAA

SEQ ID NO: 641 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAEAAAAA

SEQ ID NO: 642 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAASAAAAA

SEQ ID NO: 643 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Two pentenyl-alanine olefin side chains, each of which is crosslinked to another amino acid as indicated
  misc_feature (11)..(15): Crosslink between residues
  MOD_RES (15)..(15): Alpha-Me R5-pentenyl-alanine olefin amino acid connected by an all-carbon crosslinker comprising one double bond
  C-term NH2
LTFAEYWAQLAAAAAAA

SEQ ID NO: 644 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Alpha-Me S5-pentenyl-alanine olefin amino acid connected by an all-carbon crosslinker comprising one double bond
  misc_feature (13)..(17): Crosslink between residues
  MOD_RES (17)..(17): Alpha-Me S5-pentenyl-alanine olefin amino acid connected by an all-carbon crosslinker comprising one double bond
  C-term NH2
LTFAEYWAQLAAAAAAAA

SEQ ID NO: 645 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Alpha-Me S5-pentenyl-alanine olefin amino acid connected by an all-carbon crosslinker comprising one double bond
  misc_feature (14)..(18): Crosslink between residues
  MOD_RES (18)..(18): Alpha-Me S5-pentenyl-alanine olefin amino acid connected by an all-carbon crosslinker comprising one double bond
  C-term NH2
LTFAEYWAQLAAAAAAAAA

SEQ ID NO: 646 - protein, 20 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  misc_feature (15)..(19): Crosslink between residues
  MOD_RES (19)..(19): Alpha-Me S5-pentenyl-alanine olefin amino acid connected by an all-carbon crosslinker comprising one double bond
  C-term NH2
LTFAEYWAQLAAAAAAAAAA

SEQ ID NO: 647 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term OH
AAALTFAEYWAQLAAAA

SEQ ID NO: 648 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
AAALTFAEYWAQLAAAA

SEQ ID NO: 649 - protein, 18 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
  C-term NH2
AAAALTFAEYWAQLAAAA

SEQ ID NO: 650 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  misc_feature (9)..(16): Crosslink between residues
  MOD_RES (16)..(16): Alpha-Me S5-pentenyl-alanine olefin amino acid connected by an all-carbon crosslinker comprising one double bond
  C-term NH2
AAAAALTFAEYWAQLAAAA

SEQ ID NO: 651 - protein, 20 aa, Artificial Sequence
  Description of Artificial Sequence: Synthetic peptide
  N-term Ac
  MOD_RES (10)..(10): Alpha-Me R8-octenyl-alanine olefin amino acid connected by an all-carbon crosslinker comprising one double bond
  misc_feature (10)..(17): Crosslink between residues
  MOD_RES (17)..(17): Alpha-Me S5-pentenyl-alanine olefin amino acid connected by an all-carbon crosslinker comprising one double bond
  C-term NH2
AAAAAALTFAEYWAQLAAAA

SEQ ID NO: 652 - protein, 14 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (10)..(10): Cyclobutyl-Ala
  MOD_RES (11)..(11): Alpha-Me S6-hexynyl-alanine alkynyl amino acid wherein the alkyne forms one half of a dialkyne bond with a second alkynyl amino acid
  C-term NH2
LTFAEYWAQAASAA

SEQ ID NO: 653 - protein, 12 aa, Artificial Sequence
  Description of Artificial Sequence: Synthetic peptide
  N-term Ac
  MOD_RES (1)..(1): D-amino acid
  MOD_RES (2)..(2): Alpha-Me R5-pentenyl-alanine olefin amino acid connected by an all-carbon crosslinker comprising one double bond
  misc_feature (2)..(6): Crosslink between residues
  MOD_RES (3)..(5): D-amino acid
  MOD_RES (6)..(6): Alpha-Me R5-pentenyl-alanine olefin amino acid connected by an all-carbon crosslinker comprising one double bond
  MOD_RES (7)..(7): D-Phe-4CF3
  MOD_RES (8)..(12): D-amino acid
  C-term NH2
TAWYAAFEKLLR

SEQ ID NO: 654 - protein, 12 aa, Artificial Sequence
  Description of Artificial Sequence: Synthetic peptide
  N-term Ac
  MOD_RES (1)..(4): D-amino acid
  MOD_RES (5)..(5): Alpha-Me R5-pentenyl-alanine olefin amino acid connected by an all-carbon crosslinker comprising one double bond
  misc_feature (5)..(9): Crosslink between residues
  MOD_RES (6)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  MOD_RES (10)..(12): D-amino acid
  C-term NH2
TAWYANFEALLR

SEQ ID NO: 655 - protein, 12 aa, Artificial Sequence
  Description of Artificial Sequence: Synthetic peptide
  N-term Ac
  MOD_RES (1)..(5): D-amino acid
  MOD_RES (6)..(6): Alpha-Me R5-pentenyl-alanine olefin amino acid connected by an all-carbon crosslinker comprising one double bond
  misc_feature (6)..(10): Crosslink between residues
  MOD_RES (7)..(7): D-Phe-4CF3
  MOD_RES (8)..(9): D-amino acid
  MOD_RES (10)..(10): Alpha-Me R5-pentenyl-alanine olefin amino acid connected by an all-carbon crosslinker comprising one double bond
  MOD_RES (11)..(12): D-amino acid
  C-term NH2
TAWYAAFEKALR

SEQ ID NO: 656 - protein, 14 aa, Artificial Sequence
  Description of Artificial Sequence: Synthetic peptide
  N-term Ac
  MOD_RES (1)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  misc_feature (9)..(13): Crosslink between residues
  MOD_RES (10)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
TAWYANFEALLRAA

SEQ ID NO: 657 - protein, 12 aa, Artificial Sequence
  Description of Artificial Sequence: Synthetic peptide
  N-term Ac
  MOD_RES (1)..(1): D-amino acid
  MOD_RES (2)..(2): Alpha-Me S8-octenyl-alanine olefin amino acid connected by an all-carbon crosslinker comprising one double bond
  misc_feature (2)..(9): Crosslink between residues
  MOD_RES (3)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  MOD_RES (10)..(12): D-amino acid
  C-term NH2
TAWYANFEALLR

SEQ ID NO: 658 - protein, 13 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(13): D-amino acid
  C-term NH2
TAWYANFEKLLAA

SEQ ID NO: 659 - protein, 14 aa, Artificial Sequence
  Description of Artificial Sequence: Synthetic peptide
  N-term Ac
  MOD_RES (1)..(5): D-amino acid
  MOD_RES (6)..(6): Alpha-Me S8-octenyl-alanine olefin amino acid connected by an all-carbon crosslinker comprising one double bond
  misc_feature (6)..(13): Crosslink between residues
  MOD_RES (7)..(7): D-Phe-4CF3
  MOD_RES (8)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
TAWYAAFEKLLRAA

SEQ ID NO: 660 - protein, 13 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(11): D-amino acid
  MOD_RES (12)..(12): Alpha-Me R5-pentenyl-alanine olefin amino acid connected by an all-carbon crosslinker comprising one double bond
  MOD_RES (13)..(13): D-amino acid
  C-term NH2
TAWYANAEKLLAA

SEQ ID NO: 661 - protein, 14 aa, Artificial Sequence
  Description of Artificial Sequence: Synthetic peptide
  N-term 5-FAM
  MOD_RES (1)..(1): Beta-Ala
  MOD_RES (2)..(5): D-amino acid
  MOD_RES (6)..(6): Alpha-Me S8-octenyl-alanine olefin amino acid connected by an all-carbon crosslinker comprising one double bond
  misc_feature (6)..(13): Crosslink between residues
  MOD_RES (7)..(7): D-amino acid
  MOD_RES (8)..(8): D-Phe-4CF3
  MOD_RES (9)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
ATAWYANFEKLLAA

SEQ ID NO: 662 - protein, 14 aa, Artificial Sequence
  Description of Artificial Sequence: Synthetic peptide
  N-term 5-FAM
  MOD_RES (1)..(1): Beta-Ala
  MOD_RES (2)..(5): D-amino acid
  MOD_RES (6)..(6): Alpha-Me S8-octenyl-alanine olefin amino acid connected by an all-carbon crosslinker comprising one double bond
  misc_feature (6)..(13): Crosslink between residues
  MOD_RES (7)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
ATAWYANAEKLLAA

SEQ ID NO: 663 - protein, 13 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(13): D-amino acid
  C-term NH2
TAWYANFEALLAA

SEQ ID NO: 664 - protein, 17 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(17): D-amino acid
  C-term NH2
TAWYANFEKLLAAAAAA

SEQ ID NO: 665 - protein, 17 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(17): D-amino acid
  C-term NH2
TAWYANFEALLAAAAAA

SEQ ID NO: 666 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 667 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 668 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 669 - protein, 20 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  MOD_RES (20)..(20): D-amino acid
  C-term NH2
AAALTFAEYWAQLAAAAAAA

SEQ ID NO: 670 - protein, 17 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 671 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (17)..(17): D-amino acid
  C-term NH2
LTFAEYWAQLAAXAAAA

SEQ ID NO: 672 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): 2-aminoisobutyric acid
  MOD_RES (17)..(17): D-amino acid
  C-term NH2
LTFAEYWAQLAAAAXAA

SEQ ID NO: 673 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): D-amino acid
  C-term NH2
LTFAEYWAQLAAAAAXA

SEQ ID NO: 674 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): 2-aminoisobutyric acid
  C-term NH2
LTFAEYWAQLAAAAAAX

SEQ ID NO: 675 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(17): D-amino acid
  C-term NH2
LTFAEYWAQLAAAAAAA

SEQ ID NO: 676 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAAAAAAA

SEQ ID NO: 677 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): Sarcosine
  C-term NH2
LTFAEYWAQLAAAAAAX

SEQ ID NO: 678 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAQLAAAAAAA

SEQ ID NO: 679 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAAYWAQLAAAAAAA

SEQ ID NO: 680 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 681 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQAAAAAAAA

SEQ ID NO: 682 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 683 - protein, 16 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  MOD_RES (16)..(16): D-amino acid
  C-term NH2
TFAEYWAQLAAAAAAA

SEQ ID NO: 684 - protein, 15 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (15)..(15): D-amino acid
  C-term NH2
FAEYWAQLAAAAAAA

SEQ ID NO: 685 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LVFAEYWAQLAAAAAAA

SEQ ID NO: 686 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
AAFAEYWAQLAAAAAAA

SEQ ID NO: 687 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAEYWAQLAAAAAA

SEQ ID NO: 688 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAAA

SEQ ID NO: 689 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAEYWAQLAAAA

SEQ ID NO: 690 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  C-term NH2
LTFAEYWAQLAAA

SEQ ID NO: 691 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAEYWAQLAA

SEQ ID NO: 692 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAA

SEQ ID NO: 693 - protein, 12 aa, Artificial Sequence
  Description of Artificial Sequence: Synthetic peptide
  N-term Ac
  MOD_RES (1)..(12): D-amino acid
  C-term NH2
TAWYANFEKLLR

SEQ ID NO: 694 - protein, 12 aa, Artificial Sequence
  Description of Artificial Sequence: Synthetic peptide
  N-term Ac
  MOD_RES (1)..(6): D-amino acid
  MOD_RES (7)..(7): D-Phe-4CF3
  MOD_RES (8)..(12): D-amino acid
  C-term NH2
TAWYANFEKLLR

SEQ ID NO: 695 - protein, 12 aa, Artificial Sequence
  Description of Artificial Sequence: Synthetic peptide
  N-term Ac
  MOD_RES (1)..(1): D-amino acid
  MOD_RES (2)..(2): Alpha-Me R5-pentenyl-alanine olefin amino acid connected by an all-carbon crosslinker comprising one double bond
  misc_feature (2)..(6): Crosslink between residues
  MOD_RES (3)..(5): D-amino acid
  MOD_RES (6)..(6): Alpha-Me R5-pentenyl-alanine olefin amino acid connected by an all-carbon crosslinker comprising one double bond
  MOD_RES (7)..(7): D-Phe-4CF3
  MOD_RES (8)..(12): D-amino acid
  C-term NH2
TAWYAAFEKLLR

SEQ ID NO: 696 - protein, 12 aa, Artificial Sequence
  Description of Artificial Sequence: Synthetic peptide
  N-term Ac
  MOD_RES (1)..(4): D-amino acid
  MOD_RES (5)..(5): Alpha-Me R5-pentenyl-alanine olefin amino acid connected by an all-carbon crosslinker comprising one double bond
  misc_feature (5)..(9): Crosslink between residues
  MOD_RES (6)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  MOD_RES (10)..(12): D-amino acid
  C-term NH2
TAWYANFEALLR

SEQ ID NO: 697 - protein, 12 aa, Artificial Sequence
  Description of Artificial Sequence: Synthetic peptide
  N-term Ac
  MOD_RES (1)..(5): D-amino acid
  MOD_RES (6)..(6): Alpha-Me R5-pentenyl-alanine olefin amino acid connected by an all-carbon crosslinker comprising one double bond
  misc_feature (6)..(10): Crosslink between residues
  MOD_RES (7)..(7): D-Phe-4CF3
  MOD_RES (8)..(9): D-amino acid
  MOD_RES (10)..(10): Alpha-Me R5-pentenyl-alanine olefin amino acid connected by an all-carbon crosslinker comprising one double bond
  MOD_RES (11)..(12): D-amino acid
  C-term NH2
TAWYAAFEKALR

SEQ ID NO: 698 - protein, 14 aa, Artificial Sequence
  Description of Artificial Sequence: Synthetic peptide
  N-term Ac
  MOD_RES (1)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  misc_feature (9)..(13): Crosslink between residues
  MOD_RES (10)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
TAWYANFEALLRAA

SEQ ID NO: 699 - protein, 12 aa, Artificial Sequence
  Description of Artificial Sequence: Synthetic peptide
  N-term Ac
  MOD_RES (1)..(1): D-amino acid
  MOD_RES (2)..(2): Alpha-Me S8-octenyl-alanine olefin amino acid connected by an all-carbon crosslinker comprising one double bond
  misc_feature (2)..(9): Crosslink between residues
  MOD_RES (3)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  MOD_RES (10)..(12): D-amino acid
  C-term NH2
TAWYANFEALLR

SEQ ID NO: 700 - protein, 13 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(13): D-amino acid
  C-term NH2
TAWYANFEKLLAA

SEQ ID NO: 701 - protein, 14 aa, Artificial Sequence
  Description of Artificial Sequence: Synthetic peptide
  N-term Ac
  MOD_RES (1)..(5): D-amino acid
  MOD_RES (6)..(6): Alpha-Me S8-octenyl-alanine olefin amino acid connected by an all-carbon crosslinker comprising one double bond
  misc_feature (6)..(13): Crosslink between residues
  MOD_RES (7)..(7): D-Phe-4CF3
  MOD_RES (8)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
TAWYAAFEKLLRAA

SEQ ID NO: 702 - protein, 17 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(17): D-amino acid
  C-term NH2
TAWYANFEKLLAAAAAA

SEQ ID NO: 703 - protein, 17 aa, Artificial Sequence
  Description of Artificial Sequence: Synthetic peptide
  N-term Ac
  MOD_RES (4)..(4): Any amino acid available for crosslinking
  misc_feature (4)..(11): Crosslink between residues
  MOD_RES (11)..(11): Any amino acid available for crosslinking
  MOD_RES (17)..(17): D-amino acid
  C-term NH2
  see specification as filed for detailed description of substitutions and preferred embodiments
LTFXEYWAQLXAAAAAA

SEQ ID NO: 704 - protein, 16 aa, Artificial Sequence
  Description of Artificial Sequence: Synthetic peptide
  MOD_RES (2)..(2): Alpha-Me R5-pentenyl-alanine olefin amino acid connected by an all-carbon crosslinker comprising one double bond
  misc_feature (2)..(9): Crosslink between residues
  MOD_RES (9)..(9): Alpha-Me S8-octenyl-alanine olefin amino acid connected by an all-carbon crosslinker comprising one double bond
LAQETFSDAWKLLPEN

SEQ ID NO: 705 - protein, 16 aa, Artificial Sequence
  Description of Artificial Sequence: Synthetic peptide
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
LSQATFSDLWALLPEN

SEQ ID NO: 706 - protein, 16 aa, Artificial Sequence
  Description of Artificial Sequence: Synthetic peptide
  MOD_RES (5)..(5): Alpha-Me R5-pentenyl-alanine olefin amino acid connected by an all-carbon crosslinker comprising one double bond
  misc_feature (5)..(12): Crosslink between residues
  MOD_RES (12)..(12): Alpha-Me S8-octenyl-alanine olefin amino acid connected by an all-carbon crosslinker comprising one double bond
LSQEAFSDLWKALPEN

SEQ ID NO: 707 - protein, 16 aa, Artificial Sequence
  Description of Artificial Sequence: Synthetic peptide
  MOD_RES (6)..(6): Alpha-Me R5-pentenyl-alanine olefin amino acid connected by an all-carbon crosslinker comprising one double bond
  misc_feature (6)..(13): Crosslink between residues
  MOD_RES (13)..(13): Alpha-Me S8-octenyl-alanine olefin amino acid connected by an all-carbon crosslinker comprising one double bond
LSQETASDLWKLAPEN

SEQ ID NO: 708 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQETFADLWKLLAEN

SEQ ID NO: 709 - protein, 16 aa, Artificial Sequence
  Description of Artificial Sequence: Synthetic peptide
  MOD_RES (2)..(2): Any amino acid
  MOD_RES (8)..(8): Alpha-Me R5-pentenyl-alanine olefin amino acid connected by an all-carbon crosslinker comprising one double bond
  misc_feature (8)..(15): Crosslink between residues
  MOD_RES (15)..(15): Alpha-Me S8-octenyl-alanine olefin amino acid connected by an all-carbon crosslinker comprising one double bond
LXQETFSALWKLLPAN

SEQ ID NO: 710 - protein, 16 aa, Artificial Sequence
  Description of Artificial Sequence: Synthetic peptide
  MOD_RES (9)..(9): Alpha-Me R5-pentenyl-alanine olefin amino acid connected by an all-carbon crosslinker comprising one double bond
  misc_feature (9)..(16): Crosslink between residues
  MOD_RES (16)..(16): Alpha-Me S8-octenyl-alanine olefin amino acid connected by an all-carbon crosslinker comprising one double bond
LSQETFSDAWKLLPEA

SEQ ID NO: 711 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFADLWKLLAEN

SEQ ID NO: 712 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQETFADLWKLLAQN

SEQ ID NO: 713 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFADLWKLLAQN

SEQ ID NO: 714 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQETFANLWKLLAQN

SEQ ID NO: 715 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFANLWKLLAQN

SEQ ID NO: 716 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFANLWRLLAQN

SEQ ID NO: 717 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTFANLWKLLAQN

SEQ ID NO: 718 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTFANLWRLLAQN

SEQ ID NO: 719 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTAANLWRLLAQN

SEQ ID NO: 720 - protein, 16 aa, Artificial Sequence
  Description of Artificial Sequence: Synthetic peptide
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
LAQETFSDAWKLLPEN

SEQ ID NO: 721 - protein, 16 aa, Artificial Sequence
  Description of Artificial Sequence: Synthetic peptide
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
LSQATFSDLWALLPEN

SEQ ID NO: 722 - protein, 16 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
LSQEAFSDLWKALPEN

SEQ ID NO: 723 - protein, 16 aa, Artificial Sequence
  Description of Artificial Sequence: Synthetic peptide
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
LSQETASDLWKLAPEN

SEQ ID NO: 724 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQETFADLWKLLAEN

SEQ ID NO: 725 - protein, 16 aa, Artificial Sequence
  Description of Artificial Sequence: Synthetic peptide
  MOD_RES (2)..(2): Any amino acid
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
LXQETFSALWKLLPAN

SEQ ID NO: 726 - protein, 16 aa, Artificial Sequence
  Description of Artificial Sequence: Synthetic peptide
  MOD_RES (9)..(9): Alpha-Me R8-octenyl-alanine olefin amino acid connected by an all-carbon crosslinker comprising one double bond
  misc_feature (9)..(16): Crosslink between residues
  MOD_RES (16)..(16): Alpha-Me S5-pentenyl-alanine olefin amino acid connected by an all-carbon crosslinker comprising one double bond
LSQETFSDAWKLLPEA

SEQ ID NO: 727 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFADLWKLLAEN

SEQ ID NO: 728 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQETFADLWKLLAQN

SEQ ID NO: 729 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFADLWKLLAQN

SEQ ID NO: 730 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQETFANLWKLLAQN

SEQ ID NO: 731 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFANLWKLLAQN

SEQ ID NO: 732 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFANLWRLLAQN

SEQ ID NO: 733 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFANLWKLLAQN

SEQ ID NO: 734 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFANLWRLLAQN

SEQ ID NO: 735 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTAANLWRLLAQN

SEQ ID NO: 736 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFANLWRKKAQN

SEQ ID NO: 737 - protein, 14 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
QQTFADLWRLLAEN

SEQ ID NO: 738 - protein, 12 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
QQTFADLWRLLA

SEQ ID NO: 739 - protein, 13 aa, Artificial Sequence
  Description of Artificial Sequence: Synthetic peptide
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
LSQQTFADLWALL

SEQ ID NO: 740 - protein, 11 aa, Artificial Sequence
  Description of Artificial Sequence: Synthetic peptide
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
QQTFADLWALL

SEQ ID NO: 741 - protein, 14 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
QQTAADLWRLLAEN

SEQ ID NO: 742 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTFANLWRLLAQN

SEQ ID NO: 743 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTAANLWRLLAQN

SEQ ID NO: 744 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFADLWRLLAQN

SEQ ID NO: 745 - protein, 11 aa, Artificial Sequence
  Description of Artificial Sequence: Synthetic peptide
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
QTFANLWRLLA

SEQ ID NO: 746 - protein, 16 aa, Artificial Sequence
  Description of Artificial Sequence: Synthetic peptide
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
QSQQTFANLWALLPQN

SEQ ID NO: 747 - protein, 16 aa, Artificial Sequence
  Description of Artificial Sequence: Synthetic peptide
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
QSAQTFANLWRLLPQN

SEQ ID NO: 748 - protein, 10 aa, Artificial Sequence
  Description of Artificial Sequence: Synthetic peptide
  MOD_RES (1)..(1): Alpha-Me S5-pentenyl-alanine olefin amino acid connected by an all-carbon crosslinker comprising one double bond
  misc_feature (1)..(5): Crosslink between residues
  MOD_RES (5)..(5): Alpha-Me S5-pentenyl-alanine olefin amino acid connected by an all-carbon crosslinker comprising one double bond
ATFSALWKLL

SEQ ID NO: 749 - protein, 10 aa, Artificial Sequence
  Description of Artificial Sequence: Synthetic peptide
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
ETFADLWALL

SEQ ID NO: 750 - protein, 10 aa, Artificial Sequence
  Description of Artificial Sequence: Synthetic peptide
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
QTFANLWALL

SEQ ID NO: 751 - protein, 13 aa, Artificial Sequence
  Description of Artificial Sequence: Synthetic peptide
  MOD_RES (1)..(1): Alpha-Me S5-pentenyl-alanine olefin amino acid connected by an all-carbon crosslinker comprising one double bond
  misc_feature (1)..(5): Crosslink between residues
  MOD_RES (5)..(5): Alpha-Me S5-pentenyl-alanine olefin amino acid connected by an all-carbon crosslinker comprising one double bond
ASQEAFSNLWKLL

SEQ ID NO: 752 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
LSQETFADLWKLLAEN

SEQ ID NO: 753 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
LSQETFANLWKLLAQN

SEQ ID NO: 754 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
LSQQTFANLWRLLAQN

SEQ ID NO: 755 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWKLLAQN

SEQ ID NO: 756 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 757 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTAANLWRLLAQN

SEQ ID NO: 758 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QXQQTFANLWRLLAQN

SEQ ID NO: 759 - protein, 16 aa, Artificial Sequence
  Description of Artificial Sequence: Synthetic peptide
  N-term Ac
  C-term NH2
QSQQTFSNLWRLLPQN

SEQ ID NO: 760 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQQTFANLWRLLAQN

SEQ ID NO: 761 - protein, 16 aa, Artificial Sequence
  Description of Artificial Sequence: Synthetic peptide
  N-term Ac
  MOD_RES (4)..(4): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQXTFANLWRLLAQN

SEQ ID NO: 762 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAAN

SEQ ID NO: 763 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
ASQQTFANLWRLLAQN

SEQ ID NO: 764 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFAALWRLLAQN

SEQ ID NO: 765 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQETFANLWRLLAQN

SEQ ID NO: 766 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTFANLWRLLAQN

SEQ ID NO: 767 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTFANLWRLLAEN

SEQ ID NO: 768 - protein, 16 aa, Artificial Sequence
  Description of Artificial Sequence: Synthetic peptide
  N-term Ac
  C-term NH2
LSQETFSDLWKLLPEN

SEQ ID NO: 769 - protein, 16 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
  C-term NH2
QSQATFSALWRLLPQN

SEQ ID NO: 770 - protein, 16 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
  C-term NH2
QSQQAFSNAWRLLPQN

SEQ ID NO: 771 - protein, 16 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  misc_feature (6)..(10): Crosslink between residues
  MOD_RES (10)..(10): Alpha-Me S5-pentenyl-alanine olefin amino acid connected by an all-carbon crosslinker comprising one double bond
  C-term NH2
QSQQTASNLARLLPQN

SEQ ID NO: 772 - protein, 16 aa, Artificial Sequence
  Description of Artificial Sequence: Synthetic peptide
  N-term Ac
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
  C-term NH2
QSQQTFANLWALLPQN

SEQ ID NO: 773 - protein, 19 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (11)..(11): 2-aminoisobutyric acid
  MOD_RES (13)..(13): Norleucine
  MOD_RES (14)..(14): Alpha-Me S5-pentenyl-alanine olefin amino acid connected by an all-carbon crosslinker comprising one double bond
  MOD_RES (17)..(17): 2-aminoisobutyric acid
  C-term NH2
RTQATFANQWXALATNXTR

SEQ ID NO: 774 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLARN

SEQ ID NO: 775 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQRTFANLWRLLAQN

SEQ ID NO: 776 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 777 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 778 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (13)..(13): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 779 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTYANLWRLLAQN

SEQ ID NO: 780 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RXQQTFANLWRLLAQN

SEQ ID NO: 781 - protein, 12 aa, Artificial Sequence
  Description of Artificial Sequence: Synthetic peptide
  N-term Ac
  C-term NH2
MPRFMDYWEGLN

SEQ ID NO: 782 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQRFANLWRLLAQN

SEQ ID NO: 783 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQRFANLWRLLAQN

SEQ ID NO: 784 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RXQQRFANLWRLLAQN

SEQ ID NO: 785 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQRFANFWRLLAQN

SEQ ID NO: 786 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQRFANYWRLLAQN

SEQ ID NO: 787 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTFANLWQLLAQN

SEQ ID NO: 788 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Alpha-Me-Leu
  MOD_RES (14)..(14): Alpha-Me S5-pentenyl-alanine olefin amino acid connected by an all-carbon crosslinker comprising one double bond
  C-term NH2
QSQQTFANLWQLLAQN

SEQ ID NO: 789 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): Alpha-Me-Leu
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 790 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFADYWEGLAQN

SEQ ID NO: 791 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWRLLAQN

SEQ ID NO: 792 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
RFANLWRLLAQ

SEQ ID NO: 793 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): 2-fluoro-Phe
  MOD_RES (14)..(14): Alpha-Me S5-pentenyl-alanine olefin amino acid connected by an all-carbon crosslinker comprising one double bond
  C-term NH2
QSQQTFANFWRLLAQN

SEQ ID NO: 794 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): 3-fluoro-Phe
  MOD_RES (14)..(14): Alpha-Me S5-pentenyl-alanine olefin amino acid connected by an all-carbon crosslinker comprising one double bond
  C-term NH2
QSQQTFANFWRLLAQN

SEQ ID NO: 795 - protein, 16 aa, Artificial Sequence
  Description of Artificial Sequence: Synthetic peptide
  N-term Ac
  MOD_RES (7)..(7): Alpha-hydrogen R8-octenyl-alanine olefin amino acid connected by an all-carbon saturated crosslinker with no double bond
  misc_feature (7)..(14): Crosslink between residues
  MOD_RES (14)..(14): Alpha-hydrogen S5-pentenyl-alanine olefin amino acid connected by an all-carbon saturated crosslinker with no double bond
  C-term NH2
QSQQTFANLWRLLAQN

SEQ ID NO: 796 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTAANLWRLLAQN

SEQ ID NO: 797 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 798 - protein, 16 aa, Artificial Sequence
  Description of Artificial Sequence: Synthetic peptide
  N-term acetylated with heptanoic acid and connected to internal olefin amino acid by an all-carbon crosslinker to position 4 comprising one double bond
  MOD_RES (4)..(4): Alpha-Me S5-pentenyl-alanine olefin amino acid connected by an all-carbon crosslinker to the N-term comprising one double bond
  C-term NH2
QSQATFSNLWRLLPQN

SEQ ID NO: 799 - protein, 16 aa, Artificial Sequence
  Description of Artificial Sequence: Synthetic peptide
  N-term acetylated with heptanoic acid and connected to internal olefin amino acid by an all-carbon crosslinker to position 4 comprising one double bond
  MOD_RES (4)..(4): Alpha-Me S5-pentenyl-alanine olefin amino acid connected by an all-carbon crosslinker to the N-term comprising one double bond
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQATFANLWRLLAQN

SEQ ID NO: 800 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (10)..(10): 6cl-Trp
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 801 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (10)..(10): Me6cl-Trp
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 802 - protein, 12 aa, Artificial Sequence
  Description of Artificial Sequence: Synthetic peptide
  N-term Ac
  C-term NH2
LTFEHYWAQLTS

SEQ ID NO: 803 - protein, 12 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
  C-term NH2
LTFAHYWAQLTS

SEQ ID NO: 804 - protein, 12 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
  C-term NH2
LTFEAYWAALTS

SEQ ID NO: 805 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one Z configured double bond
  misc_feature (4)..(11): Crosslink between residues
  MOD_RES (11)..(11): Alpha-Me S5-pentenyl-alanine olefin amino acid connected by an all-carbon crosslinker comprising one Z configured double bond
  C-term NH2
LTFAHYWAQLAS

SEQ ID NO: 806 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWRQLAS

SEQ ID NO: 807 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Two pentenyl-alanine olefin side chains, each of which is crosslinked to another amino acid as indicated
  misc_feature (7)..(14): Crosslink between residues
  MOD_RES (14)..(14): Alpha-Me S8-octenyl-alanine olefin amino acid connected by an all-carbon crosslinker comprising one double bond
  C-term NH2
QSAQTFANLWRLLAQN

SEQ ID NO: 808 - protein, 16 aa, Artificial Sequence
  Description of Artificial Sequence: Synthetic peptide
  N-term Ac
  C-term NH2
QSQQTASNLWRLLPQN

SEQ ID NO: 809 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQQTAANLWRLLAQN

SEQ ID NO: 810 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
ASQQTFANLWRLLAQN

SEQ ID NO: 811 - protein, 16 aa, Artificial Sequence
  Description of Artificial Sequence: Synthetic peptide
  N-term Ac
  MOD_RES (1)..(1): Alpha-Me S5-pentenyl-alanine olefin amino acid connected by an all-carbon crosslinker comprising one double bond
  misc_feature (1)..(5): Crosslink between residues
  MOD_RES (5)..(5): Alpha-Me S5-pentenyl-alanine olefin amino acid connected by an all-carbon crosslinker comprising one double bond
  MOD_RES (14)..(14): 2-aminoisobutyric acid
  C-term NH2
ASQQAFSNLWRLLXQN

SEQ ID NO: 812 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
  MOD_RES (14)..(14): 2-aminoisobutyric acid
  C-term NH2
QSAQTFANLWRLLXQN

SEQ ID NO: 813 - protein, 16 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
QSQQAFSNAWRLLXQN

SEQ ID NO: 814 - protein, 16 aa, Artificial Sequence
  Description of Artificial Sequence: Synthetic peptide
  N-term Ac
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
QSQQTFANLWALLXQN

SEQ ID NO: 815 - protein, 16 aa, Artificial Sequence
  Description of Artificial Sequence: Synthetic peptide
  N-term Ac
  MOD_RES (8)..(8): Alpha-Me S5-pentenyl-alanine olefin amino acid connected by an all-carbon crosslinker comprising one double bond
  misc_feature (8)..(12): Crosslink between residues
  MOD_RES (12)..(12): Alpha-Me S5-pentenyl-alanine olefin amino acid connected by an all-carbon crosslinker comprising one double bond
  MOD_RES (14)..(14): 2-aminoisobutyric acid
  C-term NH2
QSQQTFSALWRALXQN

SEQ ID NO: 816 - protein, 16 aa, Artificial Sequence
  Description of Artificial Sequence: Synthetic peptide
  N-term Ac
  MOD_RES (11)..(11): Alpha-Me S5-pentenyl-alanine olefin amino acid connected by an all-carbon crosslinker comprising one double bond
  misc_feature (11)..(15): Crosslink between residues
  MOD_RES (15)..(15): Alpha-Me S5-pentenyl-alanine olefin amino acid connected by an all-carbon crosslinker comprising one double bond
  C-term NH2
QSQQTFSNLWALLAAN

SEQ ID NO: 817 - protein, 16 aa, Artificial Sequence
  Description of Artificial Sequence: Synthetic peptide
  N-term Ac
  MOD_RES (1)..(1): Alpha-Me S5-pentenyl-alanine olefin amino acid that is not connected by a crosslinker
  MOD_RES (5)..(5): Alpha-Me S5-pentenyl-alanine olefin amino acid that is not connected by a crosslinker
  MOD_RES (14)..(14): 2-aminoisobutyric acid
  C-term NH2
ASQQAFSNLWRLLXQN

SEQ ID NO: 818 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid that is not connected by a crosslinker
  MOD_RES (7)..(7): Alpha-Me S5-pentenyl-alanine olefin amino acid that is not connected by a crosslinker
  MOD_RES (14)..(14): 2-aminoisobutyric acid
  C-term NH2
QSAQTFANLWRLLXQN

SEQ ID NO: 819 - protein, 16 aa, Artificial Sequence
  Description of Artificial Sequence: Synthetic peptide
  N-term Ac
  MOD_RES (5)..(5): Alpha-Me S5-pentenyl-alanine olefin amino acid that is not connected by a crosslinker
  MOD_RES (9)..(9): Alpha-Me S5-pentenyl-alanine olefin amino acid that is not connected by a crosslinker
  MOD_RES (14)..(14): 2-aminoisobutyric acid
  C-term NH2
QSQQAFSNAWRLLXQN

SEQ ID NO: 820 - protein, 16 aa, Artificial Sequence
  Description of Artificial Sequence: Synthetic peptide
  N-term Ac
  MOD_RES (7)..(7): Alpha-Me S5-pentenyl-alanine olefin amino acid that is not connected by a crosslinker
  MOD_RES (11)..(11): Alpha-Me S5-pentenyl-alanine olefin amino acid that is not connected by a crosslinker
  MOD_RES (14)..(14): 2-aminoisobutyric acid
  C-term NH2
QSQQTFANLWALLXQN

SEQ ID NO: 821 - protein, 16 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
  MOD_RES (14)..(14): 2-aminoisobutyric acid
  C-term NH2
QSQATFSALWRLLXQN

SEQ ID NO: 822 - protein, 16 aa, Artificial Sequence
  Description of Artificial Sequence: Synthetic peptide
  N-term Ac
  MOD_RES (4)..(4): Alpha-Me S5-pentenyl-alanine olefin amino acid that is not connected by a crosslinker
  MOD_RES (8)..(8): Alpha-Me S5-pentenyl-alanine olefin amino acid that is not connected by a crosslinker
  MOD_RES (14)..(14): 2-aminoisobutyric acid
  C-term NH2
QSQATFSALWRLLXQN

SEQ ID NO: 823 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid not connected by any crosslinker
  MOD_RES (7)..(7): Amino acid comprising two pentenyl-alanine olefin side chains that are not crosslinked
  MOD_RES (14)..(14): Alpha-Me S8-octenyl-alanine olefin amino acid not connected by any crosslinker
  C-term NH2
QSAQTFANLWRLLAQN

SEQ ID NO: 824 - protein, 16 aa, Artificial Sequence
  Description of Artificial Sequence: Synthetic peptide
  N-term Ac
  MOD_RES (1)..(1): Alpha-Me R8-octenyl-alanine olefin amino acid connected by an all-carbon crosslinker comprising one double bond
  misc_feature (1)..(8): Crosslink between residues
  MOD_RES (8)..(8): Alpha-Me S5-pentenyl-alanine olefin amino acid connected by an all-carbon crosslinker comprising one double bond
  MOD_RES (14)..(14): 2-aminoisobutyric acid
  C-term NH2
ASQQTFSALWRLLXQN

SEQ ID NO: 825 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
QSQATFSNLWALLXQN

SEQ ID NO: 826 - protein, 16 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
  C-term NH2
QSQQTFSALWRLLAAN

SEQ ID NO: 827 - protein, 16 aa, Artificial Sequence
  Description of Artificial Sequence: Synthetic peptide
  N-term Ac
  MOD_RES (3)..(3): Alpha-Me R5-pentenyl-alanine olefin amino acid connected by an all-carbon crosslinker comprising one double bond
  misc_feature (3)..(7): Crosslink between residues
  MOD_RES (7)..(7): Two pentenyl-alanine olefin side chains, each of which is crosslinked to another amino acid as indicated
  misc_feature (7)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
QSAQTFANLWALLXQN

SEQ ID NO: 828 - protein, 16 aa, Artificial Sequence
  Description of Artificial Sequence: Synthetic peptide
  N-term Ac
  MOD_RES (1)..(1): Alpha-Me R8-octenyl-alanine olefin amino acid that is not connected by a crosslinker
  MOD_RES (8)..(8): Alpha-Me S5-pentenyl-alanine olefin amino acid that is not connected by a crosslinker
  MOD_RES (14)..(14): 2-aminoisobutyric acid
  C-term NH2
ASQQTFSALWRLLXQN

SEQ ID NO: 829 - protein, 16 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  MOD_RES (14)..(14): 2-aminoisobutyric acid
  C-term NH2
QSQATFSNLWALLXQN

SEQ ID NO: 830 - protein, 16 aa, Artificial Sequence
  Description of Artificial Sequence: Synthetic peptide
  N-term Ac
  MOD_RES (8)..(8): Alpha-Me R8-octenyl-alanine olefin amino acid that is not connected by a crosslinker
  MOD_RES (15)..(15): Alpha-Me S5-pentenyl-alanine olefin amino acid that is not connected by a crosslinker
  C-term NH2
QSQQTFSALWRLLAAN

SEQ ID NO: 831 - protein, 16 aa, Artificial Sequence
  Description of Artificial Sequence: Synthetic peptide
  N-term Ac
  MOD_RES (3)..(3): Alpha-Me R5-pentenyl-alanine olefin amino acid that is not connected by a crosslinker
  MOD_RES (7)..(7): Amino acid comprising two pentenyl-alanine olefin side chains that are not crosslinked
  MOD_RES (11)..(11): Alpha-Me S5-pentenyl-alanine olefin amino acid that is not connected by a crosslinker
  MOD_RES (14)..(14): 2-aminoisobutyric acid
  C-term NH2
QSAQTFANLWALLXQN

SEQ ID NO: 832 - protein, 16 aa, Artificial Sequence
  Description of Artificial Sequence: Synthetic peptide
  N-term Ac
  MOD_RES (14)..(14): 2-aminoisobutyric acid
  C-term NH2
QSQQTFSNLWRLLXQN

SEQ ID NO: 833 - protein, 16 aa, Artificial Sequence
  Description of Artificial Sequence: Synthetic peptide
  N-term acetylated with heptanoic acid
  MOD_RES (4)..(4): Alpha-Me S5-pentenyl-alanine olefin amino acid that is not connected by a crosslinker
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQATFANLWRLLAQN

SEQ ID NO: 834 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
ASQQTFANLRWLLAQN

SEQ ID NO: 835 - protein, 15 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQQTFANLWRLLAQ

SEQ ID NO: 836 - protein, 15 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAQ

SEQ ID NO: 837 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
AAARAAAAAARAAAAA

SEQ ID NO: 838 - protein, 13 aa, Artificial Sequence
  Description of Artificial Sequence: Synthetic peptide
  N-term Ac
  C-term NH2
LTFEHYWAQLTSA

SEQ ID NO: 839 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLASA

SEQ ID NO: 840 - protein, 16 aa, Artificial Sequence
  Description of Artificial Sequence: Synthetic peptide
  N-term Ac
  C-term NH2
ASQQTFSNLWRLLPQN

SEQ ID NO: 841 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Two pentenyl-alanine olefin side chains, each of which is crosslinked to another amino acid as indicated
  misc_feature (7)..(11): Crosslink between residues
  MOD_RES (11)..(11): Alpha-Me R5-pentenyl-alanine olefin amino acid connected by an all-carbon crosslinker comprising one double bond
  MOD_RES (14)..(14): 2-aminoisobutyric acid
  C-term NH2
QSAQTFANLWALLXQN

SEQ ID NO: 842 - protein, 16 aa, Artificial Sequence
  Description of Artificial Sequence: Synthetic peptide
  N-term Ac
  MOD_RES (7)..(7): 2-aminoisobutyric acid
  MOD_RES (14)..(14): 2-aminoisobutyric acid
  C-term NH2
QSQQTFXNLWRLLXQN

SEQ ID NO: 843 - protein, 16 aa, Artificial Sequence
  Description of Artificial Sequence: Synthetic peptide
  N-term Ac
  MOD_RES (7)..(7): Norleucine
  MOD_RES (14)..(14): Norleucine
  C-term NH2
QSQQTFLNLWRLLLQN

SEQ ID NO: 844 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): 2-aminoisobutyric acid
  C-term NH2
QSQQTFANLWRLLXQN

SEQ ID NO: 845 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Norleucine
  C-term NH2
QSQQTFANLWRLLLQN

SEQ ID NO: 846 - protein, 16 aa, Artificial Sequence
  Description of Artificial Sequence: Synthetic peptide
  N-term Ac
  MOD_RES (7)..(7): 2-aminoisobutyric acid
  MOD_RES (14)..(14): Alpha-Me S5-pentenyl-alanine olefin amino acid that is not connected by a crosslinker
  C-term NH2
QSQQTFXNLWRLLAQN

SEQ ID NO: 847 - protein, 16 aa, Artificial Sequence
  Description of Artificial Sequence: Synthetic peptide
  N-term Ac
  MOD_RES (7)..(7): Norleucine
  MOD_RES (14)..(14): Alpha-Me S5-pentenyl-alanine olefin amino acid that is not connected by a crosslinker
  C-term NH2
QSQQTFLNLWRLLAQN

SEQ ID NO: 848 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (10)..(10): 6cl-Trp
  MOD_RES (12)..(12): Norleucine
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 849 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(3): Crosslink between residues
  MOD_RES (10)..(10): Me6clW
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 850 - protein, 8 aa, Artificial Sequence
  Description of Artificial Sequence: Synthetic peptide
  N-term Ac
  MOD_RES (2)..(2): Norleucine
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
  C-term NH2
FLAYWEAL

SEQ ID NO: 851 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWELLAA

SEQ ID NO: 852 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWQLLAA

SEQ ID NO: 853 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWELLAQN

SEQ ID NO: 854 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFADYWRLLAQN

SEQ ID NO: 855 - protein, 13 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWRLLAQ

SEQ ID NO: 856 - protein, 12 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWRLLA

SEQ ID NO: 857 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFADLWRLLAQN

SEQ ID NO: 858 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAEN

SEQ ID NO: 859 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAQD

SEQ ID NO: 860 - protein, 15 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAS

SEQ ID NO: 861 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
ESQQTFANLWRLLAQN

SEQ ID NO: 862 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWRLLAQ

SEQ ID NO: 863 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LRFANLWRLLAQ

SEQ ID NO: 864 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising one double bond
  C-term NH2
QSQQTFANWWRLLAQN

SEQ ID NO: 865 - protein, 15 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQ

SEQ ID NO: 866 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
QTFANLWRLLAQN

SEQ ID NO: 867 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANWWRLLAQN

SEQ ID NO: 868 - protein, 13 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANWWRLLAA

SEQ ID NO: 869 - protein, 10 aa, Artificial Sequence
  Description of Artificial Sequence: Synthetic peptide
  N-term Ac
  C-term NH2
TSFAEYWNLL

SEQ ID NO: 870 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
QTFAHWWSQLAS

SEQ ID NO: 871 - protein, 8 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
  C-term NH2
FMAYWEAL

SEQ ID NO: 872 - protein, 12 aa, Artificial Sequence
  Description of Artificial Sequence: Synthetic peptide
  N-term Ac
  C-term NH2
QTFEHWWSQLLS

SEQ ID NO: 873 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (10)..(10): Alpha-Me-Trp
  MOD_RES (13)..(13): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 874 - protein, 8 aa, Artificial Sequence
  Description of Artificial Sequence: Synthetic peptide
  N-term Ac
  MOD_RES (3)..(3): 2-aminoisobutyric acid
  MOD_RES (5)..(5): 6cl-Trp
  MOD_RES (7)..(7): Ac3c
  C-term NH2
FMXYWEXL

SEQ ID NO: 875 - protein, 8 aa, Artificial Sequence
  Description of Artificial Sequence: Synthetic peptide
  N-term Ac
  MOD_RES (2)..(2): Norleucine
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (5)..(5): 6cl-Trp
  MOD_RES (7)..(7): Alpha-Me S5-pentenyl-alanine olefin amino acid connected by an all-carbon crosslinker comprising one double bond
  C-term NH2
FLAYWEAL

SEQ ID NO: 876 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one Z configured double bond
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising one Z configured double bond
  C-term NH2
FAAYWEXLA

SEQ ID NO: 877 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 878 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (8)..(8): 6cl-Trp
  MOD_RES (12)..(12): Alpha-Me S5-pentenyl-alanine olefin amino acid connected by an all-carbon crosslinker comprising one double bond
  C-term NH2
LPRFANYWRLLAQN

SEQ ID NO: 879 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
AFAAAWALAAA

SEQ ID NO: 880 - protein, 11 aa, Artificial Sequence
  Description of Artificial Sequence: Synthetic peptide
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 881 - protein, 11 aa, Artificial Sequence
  Description of Artificial Sequence: Synthetic peptide
  N-term Pr
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 882 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 883 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAHYWAQLASA

SEQ ID NO: 884 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (12)..(12): Alpha-Me S5-pentenyl-alanine olefin amino acid connected by an all-carbon crosslinker comprising no double bonds
  C-term NH2
LPRFANYWRLLAQN

SEQ ID NO: 885 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (8)..(8): 6cl-Trp
  MOD_RES (12)..(12): Alpha-Me S5-pentenyl-alanine olefin amino acid connected by an all-carbon crosslinker comprising no double bonds
  C-term NH2
LPRFANYWRLLAQN

SEQ ID NO: 886 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising no double bonds
  C-term NH2
LTFAHYWAQLAS

SEQ ID NO: 887 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising no double bonds
  misc_feature (3)..(7): Crosslink between residues
  MOD_RES (7)..(7): Two pentenyl-alanine olefin side chains, each of which is crosslinked to another amino acid as indicated
  misc_feature (7)..(14): Crosslink between residues
  MOD_RES (14)..(14): Alpha-Me R8-octenyl-alanine olefin amino acid connected by an all carbon crosslinker comprising no double bonds
  C-term NH2
QSAQTFANLWRLLAQN

SEQ ID NO: 888 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising no double bonds
  C-term NH2
LTFAHYWRQLAS

SEQ ID NO: 889 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (10)..(10): 6cl-Trp
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 890 - protein, 16 aa, Artificial Sequence
  Description of Artificial Sequence: Synthetic peptide
  N-term Ac
  MOD_RES (1)..(1): Alpha-Me R8-octenyl-alanine olefin amino acid connected by an all-carbon crosslinker comprising no double bonds
  misc_feature (1)..(8): Crosslink between residues
  MOD_RES (8)..(8): Alpha-Me S5-pentenyl-alanine olefin amino acid connected by an all-carbon crosslinker comprising no double bonds
  MOD_RES (14)..(14): 2-aminoisobutyric acid
  C-term NH2
ASQQTFSALWRLLXQN

SEQ ID NO: 891 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAHYWAQLAS

SEQ ID NO: 892 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
TSFAQYWNLLAP

SEQ ID NO: 893 - protein, 12 aa, Artificial Sequence
  Description of Artificial Sequence: Synthetic peptide
  N-term Ac
  C-term NH2
LTFEHYWAQLTS

SEQ ID NO: 894 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one E configured double bond
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising one E configured double bond
  C-term NH2
FAAYWEXLA

SEQ ID NO: 895 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
AFAAAWALAAA

SEQ ID NO: 896 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 897 - protein, 11 aa, Artificial Sequence
  Description of Artificial Sequence: Synthetic peptide
  N-term Pr
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 898 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAHYWAQLAS

SEQ ID NO: 899 - protein, 23 aa, Artificial Sequence
  Description of Artificial Sequence: Synthetic peptide
  N-term Ac
  MOD_RES (7)..(7): Beta-Ala
  MOD_RES (14)..(14): Alpha-Me R8-octenyl-alanine olefin amino acid connected by an all-carbon crosslinker comprising one double bond
  misc_feature (14)..(21): Crosslink between residues
  MOD_RES (21)..(21): Alpha-Me S5-pentenyl-alanine olefin amino acid connected by an all-carbon crosslinker comprising one double bond
  C-term NH2
CCPGCCAQSQQTFANLWRLLAQN

SEQ ID NO: 900 - protein, 23 aa, Artificial Sequence
  Description of Artificial Sequence: Synthetic peptide
  N-term Ac
  MOD_RES (7)..(7): Beta-Ala
  MOD_RES (14)..(14): Alpha-Me R8-octenyl-alanine olefin amino acid connected by an all-carbon crosslinker comprising one double bond
  misc_feature (14)..(21): Crosslink between residues
  MOD_RES (21)..(21): Alpha-Me S5-pentenyl-alanine olefin amino acid connected by an all-carbon crosslinker comprising one double bond
  C-term NH2
CCPGCCAQSQQTAANLWRLLAQN

SEQ ID NO: 901 - protein, 21 aa, Artificial Sequence
  Description of Artificial Sequence: Synthetic peptide
  N-term Ac
  MOD_RES (7)..(7): Beta-Ala
  MOD_RES (8)..(8): Norleucine
  MOD_RES (12)..(12): Alpha-Me R8-octenyl-alanine olefin amino acid connected by an all-carbon crosslinker comprising one double bond
  misc_feature (12)..(19): Crosslink between residues
  MOD_RES (19)..(19): Alpha-Me S5-pentenyl-alanine olefin amino acid connected by an all-carbon crosslinker comprising one double bond
  C-term NH2
CCPGCCALPRFANYWRLLAQN

SEQ ID NO: 902 - protein, 12 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  C-term NH2
LTFAHYWAQLAS

SEQ ID NO: 903 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising no double bonds
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising no double bonds
  C-term NH2
FAHYWRXLA

SEQ ID NO: 904 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
QTFAHWWSQLAS

SEQ ID NO: 905 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWRQLAS

SEQ ID NO: 906 - protein, 16 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
QAQQTFSNAWRLLXQN

SEQ ID NO: 907 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (14)..(14): 2-aminoisobutyric acid
  C-term NH2
QSQQAFSNLWRALXQN

SEQ ID NO: 908 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 909 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAS

SEQ ID NO: 910 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAQ

SEQ ID NO: 911 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  C-term NH2
FAAYWEXLAS

SEQ ID NO: 912 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAS

SEQ ID NO: 913 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEQLAS

SEQ ID NO: 914 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWEQLAS

SEQ ID NO: 915 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWAQLAS

SEQ ID NO: 916 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAHYWAXLAS

SEQ ID NO: 917 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAHYWRXLAS

SEQ ID NO: 918 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-hydrogen S5-pentenyl-alanine olefin amino acid connected by an all-carbon crosslinker comprising one double bond
  C-term NH2
FAAYWEXLAA

SEQ ID NO: 919 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(3): Crosslink between residues
  MOD_RES (12)..(12): Alpha-Me S5-pentenyl-alanine olefin amino acid connected by an all-carbon crosslinker comprising no double bonds
  C-term NH2
LPTFANYWRLLAQN

SEQ ID NO: 920 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRALAQ

SEQ ID NO: 921 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
TSFAHYWAQLAS

SEQ ID NO: 922 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising no double bonds
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising no double bonds
  C-term NH2
FAAYWEXLAA

SEQ ID NO: 923 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQIAS

SEQ ID NO: 924 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 925 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAA

SEQ ID NO: 926 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Abu
  C-term NH2
LTFAHYWAQLAX

SEQ ID NO: 927 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Abu
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 928 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAAYWAQLAS

SEQ ID NO: 929 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAHYWAQLAS

SEQ ID NO: 930 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAQLAS

SEQ ID NO: 931 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAAYWAQLAA

SEQ ID NO: 932 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAQLAA

SEQ ID NO: 933 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWALLAQ

SEQ ID NO: 934 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWALLAA

SEQ ID NO: 935 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAALWALLAQ

SEQ ID NO: 936 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFANLWALLAQ

SEQ ID NO: 937 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFAALWALLAA

SEQ ID NO: 938 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
AAAYWEXLAA

SEQ ID NO: 939 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAA

SEQ ID NO: 940 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAX

SEQ ID NO: 941 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLAL

SEQ ID NO: 942 - protein, 10 aa, Artificial Sequence
  Description of Artificial Sequence: Synthetic peptide
  N-term Ac
  MOD_RES (2)..(2): Alpha-Me R5-pentenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S8-octenyl-alanine olefin amino acid connected by an all-carbon crosslinker comprising one double bond
  C-term NH2
FAAYWEXLAA

SEQ ID NO: 943 - protein, 10 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me R8-octenyl-alanine olefin amino acid connected by an all-carbon crosslinker comprising one double bond
  C-term NH2
FAAYWEXLAA

SEQ ID NO: 944 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXIAA

SEQ ID NO: 945 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Norleucine
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 946 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Alpha-Me-Leu
  MOD_RES (9)..(9): Alpha-Me S5-pentenyl-alanine olefin amino acid connected by an all-carbon crosslinker comprising one double bond
  C-term NH2
FAAYWELLAA

SEQ ID NO: 947 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  C-term NH2
FAAYWELLAA

SEQ ID NO: 948 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWQXLAA

SEQ ID NO: 949 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWAXLAA

SEQ ID NO: 950 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Abu
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWXXLAA

SEQ ID NO: 951 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Norleucine
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWLXLAA

SEQ ID NO: 952 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Abu
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAXYWEXLAA

SEQ ID NO: 953 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Norleucine
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FALYWEXLAA

SEQ ID NO: 954 - protein, 13 aa, Artificial Sequence
  Description of Artificial Sequence: Synthetic peptide
  N-term 5-FAM
  MOD_RES (1)..(1): Beta-Ala
  C-term NH2
ALTFEHYWAQLTS

SEQ ID NO: 955 - protein, 13 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (12)..(12): Alpha-Me S5-pentenyl-alanine olefin amino acid connected by an all-carbon crosslinker comprising no double bonds
  C-term NH2
ALTFAHYWAQLAS

SEQ ID NO: 956 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 957 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Tert-butyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 958 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 959 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-cyclohexyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 960 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 961 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Ac6c
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 962 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Ac5c
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 963 - protein, 12 aa, Artificial Sequence
  Description of Artificial Sequence: Synthetic peptide
  N-term Ac
  MOD_RES (3)..(3): homo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 964 - protein, 12 aa, Artificial Sequence
  Description of Artificial Sequence: Synthetic peptide
  N-term Ac
  MOD_RES (3)..(3): Indanyl-Gly
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTGAHYWAQLAS

SEQ ID NO: 965 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 966 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQFAS

SEQ ID NO: 967 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Indanyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 968 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 969 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 970 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): hY
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 971 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): hLeu
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 972 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Tert-butyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 973 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Adamantyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 974 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): homo-cyclohexyl-Ala
  MOD_RES (9)..(9): Alpha-Me S5-pentenyl-alanine olefin amino acid connected by an all-carbon crosslinker comprising one double bond
  C-term NH2
FAAYWEXAAA

SEQ ID NO: 975 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Cyclohexyl-Ala
  MOD_RES (9)..(9): Alpha-Me S5-pentenyl-alanine olefin amino acid connected by an all-carbon crosslinker comprising one double bond
  C-term NH2
FAAYWEXAAA

SEQ ID NO: 976 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac6c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 977 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac5c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 978 - protein, 10 aa, Artificial Sequence
  Description of Artificial Sequence: Synthetic peptide
  N-term Ac
  MOD_RES (1)..(1): homo-Phe
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 979 - protein, 10 aa, Artificial Sequence
  Description of Artificial Sequence: Synthetic peptide
  N-term Ac
  MOD_RES (1)..(1): Indanyl-Gly
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
GAAYWEXLAA

SEQ ID NO: 980 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXFAA

SEQ ID NO: 981 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Indanyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 982 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Cyclobutyl-Ala
  MOD_RES (9)..(9): Alpha-Me S5-pentenyl-alanine olefin amino acid connected by an all-carbon crosslinker comprising one double bond
  C-term NH2
FAAYWEXAAA

SEQ ID NO: 983 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Cyclopentyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 984 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (4)..(4): hY
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 985 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAQ

SEQ ID NO: 986 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 987 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 988 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAALAA

SEQ ID NO: 989 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Ac3c
  MOD_RES (11)..(11): Alpha-Me S5-pentenyl-alanine olefin amino acid connected by an all-carbon crosslinker comprising one double bond
  C-term NH2
LTFAHYWAXLAS

SEQ ID NO: 990 - protein, 12 aa, Artificial Sequence
  Description of Artificial Sequence: Synthetic peptide
  N-term Ac
  MOD_RES (1)..(1): Norleucine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 991 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
VTFAHYWAQLAS

SEQ ID NO: 992 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAHYWAQLAS

SEQ ID NO: 993 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAHYWAQLAS

SEQ ID NO: 994 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
RTFAHYWAQLAS

SEQ ID NO: 995 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
KTFAHYWAQLAS

SEQ ID NO: 996 - protein, 12 aa, Artificial Sequence
  Description of Artificial Sequence: Synthetic peptide
  N-term Ac
  MOD_RES (2)..(2): Norleucine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LLFAHYWAQLAS

SEQ ID NO: 997 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LVFAHYWAQLAS

SEQ ID NO: 998 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LFFAHYWAQLAS

SEQ ID NO: 999 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LWFAHYWAQLAS

SEQ ID NO: 1000 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LRFAHYWAQLAS

SEQ ID NO: 1001 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LKFAHYWAQLAS

SEQ ID NO: 1002 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Norleucine
  MOD_RES (11)..(11): Alpha-Me S5-pentenyl-alanine olefin amino acid connected by an all-carbon crosslinker comprising one double bond
  C-term NH2
LTFALYWAQLAS

SEQ ID NO: 1003 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLAS

SEQ ID NO: 1004 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAFYWAQLAS

SEQ ID NO: 1005 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAWYWAQLAS

SEQ ID NO: 1006 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFARYWAQLAS

SEQ ID NO: 1007 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAKYWAQLAS

SEQ ID NO: 1008 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Norleucine
  MOD_RES (11)..(11): Alpha-Me S5-pentenyl-alanine olefin amino acid connected by an all-carbon crosslinker comprising one double bond
  C-term NH2
LTFAHLWAQLAS

SEQ ID NO: 1009 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHVWAQLAS

SEQ ID NO: 1010 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1011 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHWWAQLAS

SEQ ID NO: 1012 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHRWAQLAS

SEQ ID NO: 1013 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHKWAQLAS

SEQ ID NO: 1014 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Norleucine
  MOD_RES (11)..(11): Alpha-Me S5-pentenyl-alanine olefin amino acid connected by an all-carbon crosslinker comprising one double bond
  C-term NH2
LTFAHYWLQLAS

SEQ ID NO: 1015 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWVQLAS

SEQ ID NO: 1016 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWFQLAS

SEQ ID NO: 1017 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWWQLAS

SEQ ID NO: 1018 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWKQLAS

SEQ ID NO: 1019 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAHYWALLAS

SEQ ID NO: 1020 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAVLAS

SEQ ID NO: 1021 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAFLAS

SEQ ID NO: 1022 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAWLAS

SEQ ID NO: 1023 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWARLAS

SEQ ID NO: 1024 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Norleucine
  C-term NH2
LTFAHYWAQLAL

SEQ ID NO: 1025 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAV

SEQ ID NO: 1026 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAF

SEQ ID NO: 1027 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAW

SEQ ID NO: 1028 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAR

SEQ ID NO: 1029 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAK

SEQ ID NO: 1030 - protein, 16 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
QAQQTFSNAWRLLXQN

SEQ ID NO: 1031 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (14)..(14): 2-aminoisobutyric acid
  C-term NH2
QSQQAFSNLWRALXQN

SEQ ID NO: 1032 - protein, 12 aa, Artificial Sequence
  Description of Artificial Sequence: Synthetic peptide
  N-term Ac
  MOD_RES (3)..(3): 2Pal
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1033 - protein, 12 aa, Artificial Sequence
  Description of Artificial Sequence: Synthetic peptide
  N-term Ac
  MOD_RES (3)..(3): 3Pal
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1034 - protein, 12 aa, Artificial Sequence
  Description of Artificial Sequence: Synthetic peptide
  N-term Ac
  MOD_RES (3)..(3): 4Pal
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1035 - protein, 12 aa, Artificial Sequence
  Description of Artificial Sequence: Synthetic peptide
  N-term Ac
  MOD_RES (3)..(3): Phe-2CF3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1036 - protein, 12 aa, Artificial Sequence
  Description of Artificial Sequence: Synthetic peptide
  N-term Ac
  MOD_RES (3)..(3): Phe-2CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1037 - protein, 12 aa, Artificial Sequence
  Description of Artificial Sequence: Synthetic peptide
  N-term Ac
  MOD_RES (3)..(3): Phe-2Me
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1038 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1039 - protein, 12 aa, Artificial Sequence
  Description of Artificial Sequence: Synthetic peptide
  N-term Ac
  MOD_RES (3)..(3): D-Phe-4CF3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1040 - protein, 12 aa, Artificial Sequence
  Description of Artificial Sequence: Synthetic peptide
  N-term Ac
  MOD_RES (3)..(3): Phe-4tBu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1041 - protein, 12 aa, Artificial Sequence
  Description of Artificial Sequence: Synthetic peptide
  N-term Ac
  MOD_RES (3)..(3): Phe-5F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1042 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(12): Crosslink between residues
  MOD_RES (7)..(7): 3Bth
  MOD_RES (12)..(12): Alpha-Me S5-pentenyl-alanine olefin amino acid connected by an all-carbon crosslinker comprising one double bond
  C-term NH2
LTFAHYXAAQLAS

SEQ ID NO: 1043 - protein, 12 aa, Artificial Sequence
  Description of Artificial Sequence: Synthetic peptide
  N-term Ac
  MOD_RES (3)..(3): Phe-2Br
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1044 - protein, 12 aa, Artificial Sequence
  Description of Artificial Sequence: Synthetic peptide
  N-term Ac
  MOD_RES (3)..(3): Phe-4Br
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1045 - protein, 12 aa, Artificial Sequence
  Description of Artificial Sequence: Synthetic peptide
  N-term Ac
  MOD_RES (3)..(3): Phe-2Cl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1046 - protein, 12 aa, Artificial Sequence
  Description of Artificial Sequence: Synthetic peptide
  N-term Ac
  MOD_RES (3)..(3): Phe-4Cl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1047 - protein, 12 aa, Artificial Sequence
  Description of Artificial Sequence: Synthetic peptide
  N-term Ac
  MOD_RES (3)..(3): Phe-3CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1048 - protein, 12 aa, Artificial Sequence
  Description of Artificial Sequence: Synthetic peptide
  N-term Ac
  MOD_RES (3)..(3): Phe-4CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1049 - protein, 12 aa, Artificial Sequence
  Description of Artificial Sequence: Synthetic peptide
  N-term Ac
  MOD_RES (3)..(3): Phe-34Cl2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1050 - protein, 12 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1051 - protein, 12 aa, Artificial Sequence
  Description of Artificial Sequence: Synthetic peptide
  N-term Ac
  MOD_RES (3)..(3): 3,5-difluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1052 - protein, 12 aa, Artificial Sequence
  Description of Artificial Sequence: Synthetic peptide
  N-term Ac
  MOD_RES (3)..(3): 3,3-di-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1053 - protein, 12 aa, Artificial Sequence
  Description of Artificial Sequence: Synthetic peptide
  N-term Ac
  MOD_RES (3)..(3): 2-Fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1054 - protein, 12 aa, Artificial Sequence
  Description of Artificial Sequence: Synthetic peptide
  N-term Ac
  MOD_RES (3)..(3): 3-fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1055 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1056 - protein, 12 aa, Artificial Sequence
  Description of Artificial Sequence: Synthetic peptide
  N-term Ac
  MOD_RES (3)..(3): 4-iodo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1057 - protein, 12 aa, Artificial Sequence
  Description of Artificial Sequence: Synthetic peptide
  N-term Ac
  MOD_RES (3)..(3): Phe-3Me
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1058 - protein, 12 aa, Artificial Sequence
  Description of Artificial Sequence: Synthetic peptide
  N-term Ac
  MOD_RES (3)..(3): Phe-4Me
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1059 - protein, 12 aa, Artificial Sequence
  Description of Artificial Sequence: Synthetic peptide
  N-term Ac
  MOD_RES (3)..(3): 1-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1060 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1061 - protein, 12 aa, Artificial Sequence
  Description of Artificial Sequence: Synthetic peptide
  N-term Ac
  MOD_RES (3)..(3): Phe-3CF3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1062 - protein, 12 aa, Artificial Sequence
  Description of Artificial Sequence: Synthetic peptide
  N-term Ac
  MOD_RES (3)..(3): Phe-4NO2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1063 - protein, 12 aa, Artificial Sequence
  Description of Artificial Sequence: Synthetic peptide
  N-term Ac
  MOD_RES (3)..(3): Phe-3NO2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1064 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): 2Thi
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1065 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Bi-Phe
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1066 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4tBu
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1067 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): D-Phe-4CF3
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1068 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4Cl
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1069 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4Me
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1070 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4Br
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1071 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4CN
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1072 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4NO2
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1073 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 1-Naphthalanine
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 1074 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 2-Naphthalanine
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 1075 - protein, 11 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(10): Crosslink between residues
  MOD_RES (10)..(10): Alpha-Me S5-pentenyl-alanine olefin amino acid connected by an all-carbon crosslinker comprising one double bond
  C-term NH2
LTFAHWAQLAS

SEQ ID NO: 1076 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 1-Naphthalanine
  MOD_RES (11)..(11): Alpha-Me S5-pentenyl-alanine olefin amino acid connected by an all-carbon crosslinker comprising one double bond
  C-term NH2
LTFAHYAAQLAS

SEQ ID NO: 1077 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 2-Naphthalanine
  MOD_RES (11)..(11): Alpha-Me S5-pentenyl-alanine olefin amino acid connected by an all-carbon crosslinker comprising one double bond
  C-term NH2
LTFAHYAAQLAS

SEQ ID NO: 1078 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQIAS

SEQ ID NO: 1079 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1080 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAHYWAQLAA

SEQ ID NO: 1081 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Abu
  C-term NH2
LTFAHYWAQLAX

SEQ ID NO: 1082 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Abu
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 1083 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAHYWAQLAS

SEQ ID NO: 1084 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWALLAQ

SEQ ID NO: 1085 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAALWALLAQ

SEQ ID NO: 1086 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFANLWALLAQ

SEQ ID NO: 1087 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWAXLAA

SEQ ID NO: 1088 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAS

SEQ ID NO: 1089 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LVFAAYWAQLAS

SEQ ID NO: 1090 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Abu
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1091 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Norleucine
  MOD_RES (11)..(11): Alpha-Me S5-pentenyl-alanine olefin amino acid connected by an all-carbon crosslinker comprising one double bond
  C-term NH2
LTFAAYWLQLAS

SEQ ID NO: 1092 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Abu
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1093 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWHQLAS

SEQ ID NO: 1094 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWKQLAS

SEQ ID NO: 1095 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Ornithine
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1096 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRQLAS

SEQ ID NO: 1097 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1098 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRALAS

SEQ ID NO: 1099 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRQLAA

SEQ ID NO: 1100 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRALAA

SEQ ID NO: 1101 - protein, 12 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  C-term NH2
LTFAHYWAQLAS

SEQ ID NO: 1102 - protein, 12 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(11): Crosslink between residues
  MOD_RES (11)..(11): Alpha-Me R8-octenyl-alanine olefin amino acid connected by an all-carbon crosslinker comprising one double bond
  C-term NH2
LTFAHYWAQLAS

SEQ ID NO: 1103 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAALAS

SEQ ID NO: 1104 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Abu
  MOD_RES (11)..(11): Alpha-Me S5-pentenyl-alanine olefin amino acid connected by an all-carbon crosslinker comprising one double bond
  C-term NH2
LTFAHYWAXLAS

SEQ ID NO: 1105 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWALLAS

SEQ ID NO: 1106 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWHALAA

SEQ ID NO: 1107 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAALAA

SEQ ID NO: 1108 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWSALAA

SEQ ID NO: 1109 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWRALAA

SEQ ID NO: 1110 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWKALAA

SEQ ID NO: 1111 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAYWXALAA

SEQ ID NO: 1112 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAVYWEXLAA

SEQ ID NO: 1113 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAFYWEXLAA

SEQ ID NO: 1114 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAWYWEXLAA

SEQ ID NO: 1115 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FARYWEXLAA

SEQ ID NO: 1116 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAKYWEXLAA

SEQ ID NO: 1117 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (4)..(4): Norleucine
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAALWEXLAA

SEQ ID NO: 1118 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAVWEXLAA

SEQ ID NO: 1119 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAFWEXLAA

SEQ ID NO: 1120 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAWWEXLAA

SEQ ID NO: 1121 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAARWEXLAA

SEQ ID NO: 1122 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAKWEXLAA

SEQ ID NO: 1123 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWVXLAA

SEQ ID NO: 1124 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWFXLAA

SEQ ID NO: 1125 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWWXLAA

SEQ ID NO: 1126 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWRXLAA

SEQ ID NO: 1127 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWKXLAA

SEQ ID NO: 1128 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEVLAA

SEQ ID NO: 1129 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEFLAA

SEQ ID NO: 1130 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEWLAA

SEQ ID NO: 1131 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWERLAA

SEQ ID NO: 1132 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEKLAA

SEQ ID NO: 1133 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAV

SEQ ID NO: 1134 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAF

SEQ ID NO: 1135 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAW

SEQ ID NO: 1136 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAR

SEQ ID NO: 1137 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAK

SEQ ID NO: 1138 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAV

SEQ ID NO: 1139 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAF

SEQ ID NO: 1140 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAW

SEQ ID NO: 1141 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAR

SEQ ID NO: 1142 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAK

SEQ ID NO: 1143 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAH

SEQ ID NO: 1144 - protein, 12 aa, Artificial Sequence
  Description of Artificial Sequence: Synthetic peptide
  N-term Ac
  MOD_RES (3)..(3): Phe-2NO2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1145 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAAQLAS

SEQ ID NO: 1146 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYAAQLAS

SEQ ID NO: 1147 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWALLAAN

SEQ ID NO: 1148 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QXQQTFANLWALLAAN

SEQ ID NO: 1149 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QXQQTFAALWALLAAN

SEQ ID NO: 1150 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
AAAATFAAAWAALAAA

SEQ ID NO: 1151 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAAWRALAQ

SEQ ID NO: 1152 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWAALAQ

SEQ ID NO: 1153 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRALAA

SEQ ID NO: 1154 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
VFAAAWRALAQ

SEQ ID NO: 1155 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
AFAAAWAALAA

SEQ ID NO: 1156 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWKALAQ

SEQ ID NO: 1157 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (7)..(7): Ornithine
  MOD_RES (10)..(10): Alpha-Me S5-pentenyl-alanine olefin amino acid connected by an all-carbon crosslinker comprising one double bond
  C-term NH2
TFAAAWXALAQ

SEQ ID NO: 1158 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWSALAQ

SEQ ID NO: 1159 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAAWRALAQ

SEQ ID NO: 1160 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLAA

SEQ ID NO: 1161 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWAALAA

SEQ ID NO: 1162 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWAQLAA

SEQ ID NO: 1163 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALA

SEQ ID NO: 1164 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAALA

SEQ ID NO: 1165 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWKALA

SEQ ID NO: 1166 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAYWXALA

SEQ ID NO: 1167 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWQALA

SEQ ID NO: 1168 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLA

SEQ ID NO: 1169 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWDQLAS

SEQ ID NO: 1170 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHFWEQLAS

SEQ ID NO: 1171 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWHQLAS

SEQ ID NO: 1172 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWKQLAS

SEQ ID NO: 1173 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAYWXQLAS

SEQ ID NO: 1174 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWSQLAS

SEQ ID NO: 1175 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHWWEQLAS

SEQ ID NO: 1176 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHWWAQLAS

SEQ ID NO: 1177 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWHQLAS

SEQ ID NO: 1178 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWKQLAS

SEQ ID NO: 1179 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAWWXQLAS

SEQ ID NO: 1180 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHWWSQLAS

SEQ ID NO: 1181 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANYWALLAQ

SEQ ID NO: 1182 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFANLWAQLAQ

SEQ ID NO: 1183 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANYWALLAA

SEQ ID NO: 1184 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFANLWAQLAA

SEQ ID NO: 1185 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAAYWALLAQ

SEQ ID NO: 1186 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAALWAQLAQ

SEQ ID NO: 1187 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFANYWALLAQ

SEQ ID NO: 1188 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFANLWAQLAQ

SEQ ID NO: 1189 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFAAYWALLAA

SEQ ID NO: 1190 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAALWAQLAA

SEQ ID NO: 1191 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAALAA

SEQ ID NO: 1192 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (11)..(11): 2-aminoisobutyric acid
  C-term NH2
FAAYWEXLAAX

SEQ ID NO: 1193 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLAAA

SEQ ID NO: 1194 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWAXLAAA

SEQ ID NO: 1195 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWSXLAAA

SEQ ID NO: 1196 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAS

SEQ ID NO: 1197 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAT

SEQ ID NO: 1198 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAL

SEQ ID NO: 1199 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAQ

SEQ ID NO: 1200 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAFWEXLAAA

SEQ ID NO: 1201 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAWWEXLAAA

SEQ ID NO: 1202 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLASA

SEQ ID NO: 1203 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1204 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  C-term NH2
FAAYWELLAAA

SEQ ID NO: 1205 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAXA

SEQ ID NO: 1206 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLALA

SEQ ID NO: 1207 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLALA

SEQ ID NO: 1208 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEALALA

SEQ ID NO: 1209 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWELLALA

SEQ ID NO: 1210 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAX

SEQ ID NO: 1211 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWELLAX

SEQ ID NO: 1212 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEALAX

SEQ ID NO: 1213 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAFWAQLAS

SEQ ID NO: 1214 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAWWAQLAS

SEQ ID NO: 1215 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQIAS

SEQ ID NO: 1216 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1217 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASA

SEQ ID NO: 1218 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAWWAQLAA

SEQ ID NO: 1219 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQIAA

SEQ ID NO: 1220 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAAYWAQLAA

SEQ ID NO: 1221 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAA

SEQ ID NO: 1222 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHWWAQLAS

SEQ ID NO: 1223 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHRWAQLAS

SEQ ID NO: 1224 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHKWAQLAS

SEQ ID NO: 1225 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAW

SEQ ID NO: 1226 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Abu
  MOD_RES (9)..(9): Alpha-Me S5-pentenyl-alanine olefin amino acid connected by an all-carbon crosslinker comprising one double bond
  C-term NH2
FAAYWXALAA

SEQ ID NO: 1227 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Abu
  MOD_RES (9)..(9): Alpha-Me S5-pentenyl-alanine olefin amino acid connected by an all-carbon crosslinker comprising one double bond
  C-term NH2
FAXYWEALAA

SEQ ID NO: 1228 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (12)..(12): Alpha-Me S5-pentenyl-alanine olefin amino acid connected by an all-carbon crosslinker comprising no double bonds
  C-term NH2
LPRFANYWRLLAQN

SEQ ID NO: 1229 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
TSFAHYWAQLAS

SEQ ID NO: 1230 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAAYWAQLAS

SEQ ID NO: 1231 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
HTFAHYWAQLAS

SEQ ID NO: 1232 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LHFAHYWAQLAS

SEQ ID NO: 1233 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHHWAQLAS

SEQ ID NO: 1234 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWHQLAS

SEQ ID NO: 1235 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAHLAS

SEQ ID NO: 1236 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAH

SEQ ID NO: 1237 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHPr
LTFAHYWAQLAS

SEQ ID NO: 1238 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHsBu
LTFAHYWAQLAS

SEQ ID NO: 1239 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHiBu
LTFAHYWAQLAS

SEQ ID NO: 1240 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHBn
LTFAHYWAQLAS

SEQ ID NO: 1241 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHPe
LTFAHYWAQLAS

SEQ ID NO: 1242 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHChx
LTFAHYWAQLAS

SEQ ID NO: 1243 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAS

SEQ ID NO: 1244 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
STFAAYWAQLAS

SEQ ID NO: 1245 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LEFAAYWAQLAS

SEQ ID NO: 1246 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LSFAAYWAQLAS

SEQ ID NO: 1247 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAS

SEQ ID NO: 1248 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFASYWAQLAS

SEQ ID NO: 1249 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWEQLAS

SEQ ID NO: 1250 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAELAS

SEQ ID NO: 1251 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWASLAS

SEQ ID NO: 1252 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAE

SEQ ID NO: 1253 - protein, 12 aa, Artificial Sequence
  Description of Artificial Sequence: Synthetic peptide
  N-term Ac
  MOD_RES (3)..(3): Phe-2CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1254 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1255 - protein, 12 aa, Artificial Sequence
  Description of Artificial Sequence: Synthetic peptide
  N-term Ac
  MOD_RES (3)..(3): 3,3-di-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTXAHYWAQLAS

SEQ ID NO: 1256 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Tert-butyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1257 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1258 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl6br-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1259 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl6f-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1260 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl4m-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1261 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl5cl-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1262 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl7m-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1263 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAHYWAQLAA

SEQ ID NO: 1264 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou
  MOD_RES (11)..(11): Alpha-Me S5-pentenyl-alanine olefin amino acid connected by an all-carbon crosslinker comprising one double bond
  C-term NH2
LTFAHXWAQLAS

SEQ ID NO: 1265 - protein, 12 aa, Artificial Sequence
  Description of Artificial Sequence: Synthetic peptide
  N-term Ac
  MOD_RES (6)..(6): Cou
  C-term NH2
LTFEHXWAQLTS

SEQ ID NO: 1266 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou
  MOD_RES (11)..(11): Alpha-Me S5-pentenyl-alanine olefin amino acid connected by an all-carbon crosslinker comprising one double bond
  C-term NH2
LTAAHXWAQLAS

SEQ ID NO: 1267 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEALAXA

SEQ ID NO: 1268 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEAIAAA

SEQ ID NO: 1269 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (8)..(8): Norleucine
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1270 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Alpha-Me-Leu
  MOD_RES (9)..(9): Alpha-Me S5-pentenyl-alanine olefin amino acid connected by an all-carbon crosslinker comprising one double bond
  C-term NH2
FAAYWELLAAA

SEQ ID NO: 1271 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWQALAAA

SEQ ID NO: 1272 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAALAAA

SEQ ID NO: 1273 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Abu
  MOD_RES (9)..(9): Alpha-Me S5-pentenyl-alanine olefin amino acid connected by an all-carbon crosslinker comprising one double bond
  C-term NH2
FAAYWXALAAA

SEQ ID NO: 1274 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Norleucine
  MOD_RES (9)..(9): Alpha-Me S5-pentenyl-alanine olefin amino acid connected by an all-carbon crosslinker comprising one double bond
  C-term NH2
FAAYWLALAAA

SEQ ID NO: 1275 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Abu
  MOD_RES (9)..(9): Alpha-Me S5-pentenyl-alanine olefin amino acid connected by an all-carbon crosslinker comprising one double bond
  C-term NH2
FAXYWEALAAA

SEQ ID NO: 1276 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Norleucine
  MOD_RES (9)..(9): Alpha-Me S5-pentenyl-alanine olefin amino acid connected by an all-carbon crosslinker comprising one double bond
  C-term NH2
FALYWEALAAA

SEQ ID NO: 1277 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAFYWEALAAA

SEQ ID NO: 1278 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1279 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1280 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Indanyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1281 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLAAA

SEQ ID NO: 1282 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAALWAQLAQ

SEQ ID NO: 1283 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1284 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  C-term NH2
FAAYWELLAAA

SEQ ID NO: 1285 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAX

SEQ ID NO: 1286 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWELLAX

SEQ ID NO: 1287 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEALAX

SEQ ID NO: 1288 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAXA

SEQ ID NO: 1289 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLALA

SEQ ID NO: 1290 - protein, 12 aa, Artificial Sequence
  Description of Artificial Sequence: Synthetic peptide
  N-term H
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1291 - protein, 12 aa, Artificial Sequence
  Description of Artificial Sequence: Synthetic peptide
  N-term mdPEG3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1292 - protein, 12 aa, Artificial Sequence
  Description of Artificial Sequence: Synthetic peptide
  N-term mdPEG7
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1293 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (4)..(4): Pmp
  MOD_RES (5)..(5): Et6cl-Trp
  MOD_RES (9)..(9): Alpha-Me S5-pentenyl-alanine olefin amino acid connected by an all-carbon crosslinker comprising one double bond
  C-term NH2
FAAXWEALAA

SEQ ID NO: 1294 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1295 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAA

SEQ ID NO: 1296 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWWQLAS

SEQ ID NO: 1297 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWWQLAS

SEQ ID NO: 1298 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWWQLAS

SEQ ID NO: 1299 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWWQLAA

SEQ ID NO: 1300 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWWQLAA

SEQ ID NO: 1301 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1302 - protein, 12 aa, Artificial Sequence
  Description of Artificial Sequence: Synthetic peptide
  N-term Ac
  MOD_RES (3)..(3): 2-Fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1303 - protein, 12 aa, Artificial Sequence
  Description of Artificial Sequence: Synthetic peptide
  N-term Ac
  MOD_RES (3)..(3): 3-fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1304 - protein, 12 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1305 - protein, 12 aa, Artificial Sequence
  Description of Artificial Sequence: Synthetic peptide
  N-term Ac
  MOD_RES (3)..(3): 3,5-difluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1306 - protein, 10 aa, Artificial Sequence
  Description of Artificial Sequence: Synthetic peptide
  N-term Ac
  MOD_RES (1)..(1): 3-Chloro-Phe
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1307 - protein, 11 aa, Artificial Sequence
  Description of Artificial Sequence: Synthetic peptide
  N-term Ac
  MOD_RES (1)..(1): 3-Chloro-Phe
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1308 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1309 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWEALA

SEQ ID NO: 1310 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  MOD_RES (11)..(11): Amino acid comprising two pentenyl-alanine olefin side chains that are not crosslinked
  C-term NH2
LTFAHYWAQLAS

SEQ ID NO: 1311 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHsBu
LTFAHYWAQLAS

SEQ ID NO: 1312 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
STFAAYWAQLAS

SEQ ID NO: 1313 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAELAS

SEQ ID NO: 1314 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAE

SEQ ID NO: 1315 - protein, 12 aa, Artificial Sequence
  Description of Artificial Sequence: Synthetic peptide
  N-term mdPEG3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1316 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1317 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1318 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1319 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1320 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1321 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1322 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 1323 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1324 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 1325 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1326 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1327 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1328 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1329 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1330 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1331 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1332 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1333 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-Phe
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1334 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Phe-3CF3
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1335 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Phe-3Me
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1336 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): 1-Naphthalanine
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1337 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Bi-Phe
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1338 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAFYWAQLAA

SEQ ID NO: 1339 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHAm
LTFAHYWAQLAS

SEQ ID NO: 1340 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHiAm
LTFAHYWAQLAS

SEQ ID NO: 1341 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr3Ph
LTFAHYWAQLAS

SEQ ID NO: 1342 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnBu3,3Me
LTFAHYWAQLAS

SEQ ID NO: 1343 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr
LTFAHYWAQLAS

SEQ ID NO: 1344 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnEt2Ch
LTFAHYWAQLAS

SEQ ID NO: 1345 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHHex
LTFAHYWAQLAS

SEQ ID NO: 1346 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAS

SEQ ID NO: 1347 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAA

SEQ ID NO: 1348 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg4
LTFAAYWAQLAA

SEQ ID NO: 1349 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl4m-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1350 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl5cl-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1351 - protein, 12 aa, Artificial Sequence
  Description of Artificial Sequence: Synthetic peptide
  N-term Ac
  MOD_RES (3)..(3): homo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1352 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWAQLAS

SEQ ID NO: 1353 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWAQLAS

SEQ ID NO: 1354 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVQLAS

SEQ ID NO: 1355 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAALAA

SEQ ID NO: 1356 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLAA

SEQ ID NO: 1357 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAIYWAQLAS

SEQ ID NO: 1358 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAVYWSQLAS

SEQ ID NO: 1359 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAS

SEQ ID NO: 1360 - protein, 12 aa, Artificial Sequence
  Description of Artificial Sequence: Synthetic peptide
  N-term Ac
  MOD_RES (1)..(1): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAVYWSQLAS

SEQ ID NO: 1361 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFALYWSQLAS

SEQ ID NO: 1362 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAFYWAQLAS

SEQ ID NO: 1363 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWAQLAS

SEQ ID NO: 1364 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAWYWAQLAS

SEQ ID NO: 1365 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
VTFAAYWSQLAS

SEQ ID NO: 1366 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAFYWSQLAS

SEQ ID NO: 1367 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAIYWAQLAS

SEQ ID NO: 1368 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAS

SEQ ID NO: 1369 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFALYWSQLAS

SEQ ID NO: 1370 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
YTFAFYWSQLAS

SEQ ID NO: 1371 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWEALAA

SEQ ID NO: 1372 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1373 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWSALAA

SEQ ID NO: 1374 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWQALAAA

SEQ ID NO: 1375 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LHFAAYWAQLAS

SEQ ID NO: 1376 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1377 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLAS

SEQ ID NO: 1378 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAHLAS

SEQ ID NO: 1379 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAH

SEQ ID NO: 1380 - protein, 13 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
HLTFAAYWAQLAA

SEQ ID NO: 1381 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
HHFAAYWAQLAS

SEQ ID NO: 1382 - protein, 14 aa, Artificial Sequence
  Description of Artificial Sequence: Synthetic peptide
  N-term Ac
  MOD_RES (1)..(1): D-amino acid
  MOD_RES (2)..(2): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
AXWTFAVYWSQLAS

SEQ ID NO: 1383 - protein, 13 aa, Artificial Sequence
  Description of Artificial Sequence: Synthetic peptide
  N-term Ac
  MOD_RES (1)..(1): 2-aminoisobutyric acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
XWTFAHYWAQLAS

SEQ ID NO: 1384 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XAWTFAHYWAQLAS

SEQ ID NO: 1385 - protein, 13 aa, Artificial Sequence
  Description of Artificial Sequence: Synthetic peptide
  N-term Ac
  MOD_RES (1)..(1): D-amino acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
FWTFAHYWAQLAS

SEQ ID NO: 1386 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XWWTFAHYWAQLAS

SEQ ID NO: 1387 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1388 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Norleucine
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1389 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAAYWSQLAA

SEQ ID NO: 1390 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWARLAA

SEQ ID NO: 1391 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAHLAA

SEQ ID NO: 1392 - protein, 12 aa, Artificial Sequence
  Description of Artificial Sequence: Synthetic peptide
  N-term Ac
  MOD_RES (1)..(1): D-amino acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAAYWAQLAS

SEQ ID NO: 1393 - protein, 12 aa, Artificial Sequence
  Description of Artificial Sequence: Synthetic peptide
  N-term Ac
  MOD_RES (1)..(1): 2-aminoisobutyric acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1394 - protein, 12 aa, Artificial Sequence
  Description of Artificial Sequence: Synthetic peptide
  N-term Ac
  MOD_RES (1)..(1): Alpha-Me-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAAYWAQLAS

SEQ ID NO: 1395 - protein, 12 aa, Artificial Sequence
  Description of Artificial Sequence: Synthetic peptide
  N-term Ac
  MOD_RES (1)..(1): Alpha-Me-Trp
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAAYWAQLAS

SEQ ID NO: 1396 - protein, 12 aa, Artificial Sequence
  Description of Artificial Sequence: Synthetic peptide
  N-term Ac
  MOD_RES (1)..(1): N-methyl-Leu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1397 - protein, 12 aa, Artificial Sequence
  Description of Artificial Sequence: Synthetic peptide
  N-term Ac
  MOD_RES (2)..(2): N-methyl-Thr
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1398 - protein, 12 aa, Artificial Sequence
  Description of Artificial Sequence: Synthetic peptide
  N-term Ac
  MOD_RES (2)..(2): Sarcosine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LXFAAYWAQLAS

SEQ ID NO: 1399 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LGFAAYWAQLAS

SEQ ID NO: 1400 - protein, 12 aa, Artificial Sequence
  Description of Artificial Sequence: Synthetic peptide
  N-term Ac
  MOD_RES (3)..(3): N-methyl-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1401 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAYWAQLAS

SEQ ID NO: 1402 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAA

SEQ ID NO: 1403 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAA

SEQ ID NO: 1404 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWSQLAS

SEQ ID NO: 1405 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAS

SEQ ID NO: 1406 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1407 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1408 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1409 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Phe-3CF3
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1410 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): 1-Naphthalanine
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1411 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Bi-Phe
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1412 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWAQLAS

SEQ ID NO: 1413 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVQLAS

SEQ ID NO: 1414 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAWWAQLAS

SEQ ID NO: 1415 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAVYWSQLAS

SEQ ID NO: 1416 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAS

SEQ ID NO: 1417 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFALYWSQLAS

SEQ ID NO: 1418 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAFYWAQLAS

SEQ ID NO: 1419 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
VTFAAYWSQLAS

SEQ ID NO: 1420 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLAS

SEQ ID NO: 1421 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAH

SEQ ID NO: 1422 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAHLAS

SEQ ID NO: 1423 - protein, 14 aa, Artificial Sequence
  Description of Artificial Sequence: Synthetic peptide
  N-term Ac
  MOD_RES (1)..(1): D-amino acid
  MOD_RES (2)..(2): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
AXWTFAVYWSQLAS

SEQ ID NO: 1424 - protein, 13 aa, Artificial Sequence
  Description of Artificial Sequence: Synthetic peptide
  N-term Ac
  MOD_RES (1)..(1): 2-aminoisobutyric acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
XWTFAHYWAQLAS

SEQ ID NO: 1425 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XAWTFAHYWAQLAS

SEQ ID NO: 1426 - protein, 13 aa, Artificial Sequence
  Description of Artificial Sequence: Synthetic peptide
  N-term Ac
  MOD_RES (1)..(1): D-amino acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
FWTFAHYWAQLAS

SEQ ID NO: 1427 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XWWTFAHYWAQLAS

SEQ ID NO: 1428 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1429 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Norleucine
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1430 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAAYWSQLAA

SEQ ID NO: 1431 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWARLAA

SEQ ID NO: 1432 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAHLAA

SEQ ID NO: 1433 - protein, 12 aa, Artificial Sequence
  Description of Artificial Sequence: Synthetic peptide
  N-term Ac
  MOD_RES (1)..(1): D-amino acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAAYWAQLAS

SEQ ID NO: 1434 - protein, 12 aa, Artificial Sequence
  Description of Artificial Sequence: Synthetic peptide
  N-term Ac
  MOD_RES (1)..(1): 2-aminoisobutyric acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1435 - protein, 12 aa, Artificial Sequence
  Description of Artificial Sequence: Synthetic peptide
  N-term Ac
  MOD_RES (1)..(1): Alpha-Me-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAAYWAQLAS

SEQ ID NO: 1436 - protein, 12 aa, Artificial Sequence
  Description of Artificial Sequence: Synthetic peptide
  N-term Ac
  MOD_RES (1)..(1): Alpha-Me-Trp
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAAYWAQLAS

SEQ ID NO: 1437 - protein, 12 aa, Artificial Sequence
  Description of Artificial Sequence: Synthetic peptide
  N-term Ac
  MOD_RES (1)..(1): N-methyl-Leu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1438 - protein, 12 aa, Artificial Sequence
  Description of Artificial Sequence: Synthetic peptide
  N-term Ac
  MOD_RES (2)..(2): N-methyl-Thr
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1439 - protein, 12 aa, Artificial Sequence
  Description of Artificial Sequence: Synthetic peptide
  N-term Ac
  MOD_RES (2)..(2): Sarcosine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LXFAAYWAQLAS

SEQ ID NO: 1440 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAYWAQLAS

SEQ ID NO: 1441 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAA

SEQ ID NO: 1442 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAA

SEQ ID NO: 1443 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAS

SEQ ID NO: 1444 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
YTFAFYWSQLAS

SEQ ID NO: 1445 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWSALAA

SEQ ID NO: 1446 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWVQLAS

SEQ ID NO: 1447 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEHWAQLAA

SEQ ID NO: 1448 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEYWAQLAS

SEQ ID NO: 1449 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVQLAA

SEQ ID NO: 1450 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAQLAS

SEQ ID NO: 1451 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1452 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1453 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1454 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1455 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1456 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1457 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1458 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 1459 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1460 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1461 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWVALAS

SEQ ID NO: 1462 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEHWAALAA

SEQ ID NO: 1463 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEYWAALAS

SEQ ID NO: 1464 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVALAA

SEQ ID NO: 1465 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAALAS

SEQ ID NO: 1466 - protein, 12 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAS

SEQ ID NO: 1467 - protein, 12 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWAQLAS

SEQ ID NO: 1468 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWLQLAS

SEQ ID NO: 1469 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWLQLAS

SEQ ID NO: 1470 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEHWLQLAS

SEQ ID NO: 1471 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLAS

SEQ ID NO: 1472 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1473 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAS

SEQ ID NO: 1474 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAS

SEQ ID NO: 1475 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHAm
LTFAHYWAQLAS

SEQ ID NO: 1476 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHiAm
LTFAHYWAQLAS

SEQ ID NO: 1477 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr3Ph
LTFAHYWAQLAS

SEQ ID NO: 1478 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnBu3,3Me
LTFAHYWAQLAS

SEQ ID NO: 1479 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnBu
LTFAHYWAQLAS

SEQ ID NO: 1480 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr
LTFAHYWAQLAS

SEQ ID NO: 1481 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnEt2Ch
LTFAHYWAQLAS

SEQ ID NO: 1482 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHHex
LTFAHYWAQLAS

SEQ ID NO: 1483 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAS

SEQ ID NO: 1484 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAA

SEQ ID NO: 1485 - protein, 12 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  C-term NH2
LTFAAYWAALAS

SEQ ID NO: 1486 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1487 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1488 - protein, 12 aa, Artificial Sequence
  Description of Artificial Sequence: Synthetic peptide
  N-term Ac
  MOD_RES (1)..(1): Cou
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1489 - protein, 12 aa, Artificial Sequence
  Description of Artificial Sequence: Synthetic peptide
  N-term H
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAA

SEQ ID NO: 1490 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
HHFAAYWAQLAS

SEQ ID NO: 1491 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWSQLAS

SEQ ID NO: 1492 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou
  MOD_RES (11)..(11): Alpha-Me S5-pentenyl-alanine olefin amino acid connected by an all-carbon crosslinker comprising one double bond
  C-term NH2
LTFAHXWAQLAS

SEQ ID NO: 1493 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou2
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1494 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou2
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1495 - protein, 12 aa, Artificial Sequence
  Description of Artificial Sequence: Synthetic peptide
  N-term Ac
  MOD_RES (1)..(1): Cou2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1496 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou2
  MOD_RES (11)..(11): Alpha-Me S5-pentenyl-alanine olefin amino acid connected by an all-carbon crosslinker comprising one double bond
  C-term NH2
LTFAAXWAQLAS

SEQ ID NO: 1497 - protein, 12 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1498 - protein, 12 aa, Artificial Sequence
  Description of Artificial Sequence: Synthetic peptide
  N-term Hexac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1499 - protein, 12 aa, Artificial Sequence
  Description of Artificial Sequence: Synthetic peptide
  N-term Napac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1500 - protein, 12 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1501 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAAQLAS

SEQ ID NO: 1502 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  C-term NH2
LTAAHYWAQLAS

SEQ ID NO: 1503 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYFAQLAS

SEQ ID NO: 1504 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHWAAQLAS

SEQ ID NO: 1505 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAWQLAS

SEQ ID NO: 1506 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAAQWAS

SEQ ID NO: 1507 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTWAHYWAQLAS

SEQ ID NO: 1508 - protein, 12 aa, Artificial Sequence
  Description of Artificial Sequence: Synthetic peptide
  N-term Ac
  MOD_RES (3)..(3): 1-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1509 - protein, 12 aa, Artificial Sequence
  Description of Artificial Sequence: Synthetic peptide
  N-term Ac
  MOD_RES (1)..(12): D-amino acid
  C-term NH2
TAWYANFEKLLR

SEQ ID NO: 1510 - protein, 12 aa, Artificial Sequence
  Description of Artificial Sequence: Synthetic peptide
  N-term Ac
  MOD_RES (1)..(6): D-amino acid
  MOD_RES (7)..(7): D-Phe-4CF3
  MOD_RES (8)..(12): D-amino acid
  C-term NH2
TAWYANFEKLLR

SEQ ID NO: 1511 - protein, 15 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): 2-aminoisobutyric acid
  C-term NH2
LDVNATLLALKVXAQ

SEQ ID NO: 1512 - protein, 15 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): 2-aminoisobutyric acid
  C-term NH2
LDVNATLLALKAXAQ

SEQ ID NO: 1513 - protein, 15 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): 2-aminoisobutyric acid
  C-term NH2
LDVNATLLALKVXAA

SEQ ID NO: 1514 - protein, 15 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
LDVNATLLALKVPXQ

SEQ ID NO: 1515 - protein, 15 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): 2-aminoisobutyric acid
  C-term NH2
FDVNATLLALKVXAQ

SEQ ID NO: 1516 - protein, 16 aa, Artificial Sequence
  Description of Artificial Sequence: Synthetic peptide
  N-term 5-FAM
  MOD_RES (1)..(1): Beta-Ala
  MOD_RES (2)..(2): Norleucine
  MOD_RES (6)..(6): Alpha-Me S5-pentenyl-alanine olefin amino acid connected by an all-carbon crosslinker comprising one double bond
  MISC_FEATURE (6)..(10): Crosslink between residues
  MOD_RES (10)..(10): Alpha-Me S5-pentenyl-alanine olefin amino acid connected by an all-carbon crosslinker comprising one double bond
  MOD_RES (14)..(14): 2-aminoisobutyric acid
  C-term NH2
ALDVNATLLALAVXAQ

SEQ ID NO: 1517 - protein, 15 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): 2-aminoisobutyric acid
  C-term NH2
LDVNATLLALAVXAQ

SEQ ID NO: 1518 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): 2-aminoisobutyric acid
  C-term NH2
LDVNATLLALAVXAQAA

SEQ ID NO: 1519 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  C-term NH2
LDVNATLLALAVAAQAA

SEQ ID NO: 1520 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  C-term NH2
LDVNATLLALAVAAAAA

SEQ ID NO: 1521 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  C-term NH2
LDVNATLLALAVSAQAA

SEQ ID NO: 1522 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  C-term NH2
LDVNATLLALAVQAQAA

SEQ ID NO: 1523 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  C-term NH2
LDVNATLLALAVEAQAA

SEQ ID NO: 1524 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  C-term NH2
LDVNATLLALAVSAAAA

SEQ ID NO: 1525 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  C-term NH2
LDVNATLLALAVQAAAA

SEQ ID NO: 1526 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  C-term NH2
LDVNATLLALAVEAAAA

SEQ ID NO: 1527 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): 2-aminoisobutyric acid
  C-term NH2
LDVNATLLALAVXAQAA

SEQ ID NO: 1528 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): 2-aminoisobutyric acid
  C-term OH
LDVNATLLALAVXAQAA

SEQ ID NO: 1529 - protein, 15 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  MISC_FEATURE (5)..(9): Crosslink between residues
  MOD_RES (12)..(12): Alpha-Me S5-pentenyl-alanine olefin amino acid connected by an all-carbon crosslinker comprising one double bond
  C-term NH2
LDVNATLLFLAAAAQ

SEQ ID NO: 1530 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
LDVNATLLALAVQXQAA

SEQ ID NO: 1531 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (16)..(16): 2-aminoisobutyric acid
  C-term NH2
LDVNATLLALAVQAQXA

SEQ ID NO: 1532 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
LDVNATLLALAVQXAAA

SEQ ID NO: 1533 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (16)..(16): 2-aminoisobutyric acid
  C-term NH2
LDVNATLLALAVQAAXA

SEQ ID NO: 1534 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Alpha-Me S5-pentenyl-alanine olefin amino acid connected by an all-carbon crosslinker comprising one double bond
  MOD_RES (15)..(15): 2-aminoisobutyric acid
  C-term NH2
LDVNATLLALAVQAXAA

SEQ ID NO: 1535 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  MISC_FEATURE (5)..(12): Crosslink between residues
  MOD_RES (12)..(12): Alpha-Me S5-pentenyl-alanine olefin amino acid connected by an all-carbon crosslinker comprising one double bond
  C-term NH2
LDVNATLLFLAAAAQAA

SEQ ID NO: 1536 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  MISC_FEATURE (5)..(12): Crosslink between residues
  MOD_RES (12)..(12): Alpha-Me S5-pentenyl-alanine olefin amino acid connected by an all-carbon crosslinker comprising one double bond
  C-term NH2
LDVNATLLFLAAAAAAA

SEQ ID NO: 1537 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  MISC_FEATURE (5)..(12): Crosslink between residues
  MOD_RES (12)..(12): Alpha-Me S5-pentenyl-alanine olefin amino acid connected by an all-carbon crosslinker comprising one double bond
  C-term NH2
LDVNATLLFLAAQAQAA

SEQ ID NO: 1538 - protein, 17 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  MISC_FEATURE (5)..(12): Crosslink between residues
  MOD_RES (12)..(12): Alpha-Me S5-pentenyl-alanine olefin amino acid connected by an all-carbon crosslinker comprising one double bond
  C-term NH2
LDVNATLLFLAAQAAAA

SEQ ID NO: 1539 - protein, 21 aa, Artificial Sequence
  Description of Artificial Sequence: Synthetic peptide
  N-term Ac
  C-term NH2
IWIAQELRRIGDEFNAYYARR

SEQ ID NO: 1540 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQELRAIGDEFNAYYARR

SEQ ID NO: 1541 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDEFNAYYARR

SEQ ID NO: 1542 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQELRAIGDEFNAYYARR

SEQ ID NO: 1543 - protein, 18 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  MISC_FEATURE (8)..(15): Crosslink between residues
  MOD_RES (15)..(15): Alpha-Me S5-pentenyl-alanine olefin amino acid connected by an all-carbon crosslinker comprising one double bond
  C-term NH2
WIAQALRAIGDAFNAYYA

SEQ ID NO: 1544 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFAAYYA

SEQ ID NO: 1545 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFNAYAA

SEQ ID NO: 1546 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1547 - protein, 18 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  MISC_FEATURE (8)..(15): Crosslink between residues
  MOD_RES (15)..(15): Alpha-Me S5-pentenyl-alanine olefin amino acid connected by an all-carbon crosslinker comprising one double bond
  C-term NH2
WIAQALRAIGDAFNAYYA

SEQ ID NO: 1548 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFNAYYA

SEQ ID NO: 1549 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAAALRAIGDAFNAYYA

SEQ ID NO: 1550 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALAAIGDAFNAYYA

SEQ ID NO: 1551 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIADAFNAYYA

SEQ ID NO: 1552 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAANAYYA

SEQ ID NO: 1553 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  MISC_FEATURE (7)..(14): Crosslink between residues
  MOD_RES (14)..(14): Alpha-Me S5-pentenyl-alanine olefin amino acid connected by an all-carbon crosslinker comprising one double bond
  C-term NH2
IAQALRAIGDAFNAAYA

SEQ ID NO: 1554 - protein, 19 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  MISC_FEATURE (2)..(6): Crosslink between residues
  MOD_RES (6)..(6): Alpha-Me S5-pentenyl-alanine olefin amino acid connected by an all-carbon crosslinker comprising one double bond
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDEFNAYYA

SEQ ID NO: 1555 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising no double bonds
  MISC_FEATURE (9)..(16): Crosslink between residues
  MOD_RES (16)..(16): Alpha-Me S5-pentenyl-alanine olefin amino acid connected by an all-carbon saturated crosslinker comprising no double bonds
  C-term NH2
IWIAQALRXIGDAFNXYYA

SEQ ID NO: 1556 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDEFAAYYA

SEQ ID NO: 1557 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQANAYYA

SEQ ID NO: 1558 - protein, 20 aa, Artificial Sequence
  Description of Artificial Sequence: Synthetic peptide
  N-term FITC
  MOD_RES (1)..(1): Beta-Ala
  MOD_RES (10)..(10): Alpha-Me R8-octenyl-alanine olefin amino acid connected by an all-carbon crosslinker comprising one double bond
  MISC_FEATURE (10)..(17): Crosslink between residues
  MOD_RES (17)..(17): Alpha-Me S5-pentenyl-alanine olefin amino acid connected by an all-carbon crosslinker comprising one double bond
  C-term NH2
AIWIAQALRAIGDAFNAYYA

SEQ ID NO: 1559 - protein, 20 aa, Artificial Sequence
  Description of Artificial Sequence: Synthetic peptide
  N-term 5-FAM
  MOD_RES (1)..(1): Beta-Ala
  MOD_RES (10)..(10): Alpha-Me R8-octenyl-alanine olefin amino acid connected by an all-carbon crosslinker comprising one double bond
  MISC_FEATURE (10)..(17): Crosslink between residues
  MOD_RES (17)..(17): Alpha-Me S5-pentenyl-alanine olefin amino acid connected by an all-carbon crosslinker comprising one double bond
  C-term NH2
AIWIAQALRAIGDAFNAYYA

SEQ ID NO: 1560 - protein, 20 aa, Artificial Sequence
  Description of Artificial Sequence: Synthetic peptide
  N-term 5-FAM
  MOD_RES (1)..(1): Beta-Ala
  MOD_RES (10)..(10): Alpha-Me R8-octenyl-alanine olefin amino acid connected by an all-carbon crosslinker comprising one double bond
  MISC_FEATURE (10)..(17): Crosslink between residues
  MOD_RES (17)..(17): Alpha-Me S5-pentenyl-alanine olefin amino acid connected by an all-carbon crosslinker comprising one double bond
  C-term NH2
AIWIAQALRAIGDEFNAYYA

SEQ ID NO: 1561 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAQALRAIGDAFNAYYA

SEQ ID NO: 1562 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDEFNAYYA

SEQ ID NO: 1563 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQFNAYYA

SEQ ID NO: 1564 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDEFNAYYA

SEQ ID NO: 1565 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDQFNAYYA

SEQ ID NO: 1566 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYA

SEQ ID NO: 1567 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFAAYYA

SEQ ID NO: 1568 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDAFNAYYA

SEQ ID NO: 1569 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDQFNAYYA

SEQ ID NO: 1570 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALHAIGDAFNAYYA

SEQ ID NO: 1571 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALHAIGDQFNAYYA

SEQ ID NO: 1572 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALQAIGDAFNAYYA

SEQ ID NO: 1573 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALQAIGDQFNAYYA

SEQ ID NO: 1574 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAANAYYA

SEQ ID NO: 1575 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAINAYYA

SEQ ID NO: 1576 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQINAYYA

SEQ ID NO: 1577 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAANAYYA

SEQ ID NO: 1578 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIADAFNAYYA

SEQ ID NO: 1579 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIADQFNAYYA

SEQ ID NO: 1580 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAAGDAFNAYYA

SEQ ID NO: 1581 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAAGDQFNAYYA

SEQ ID NO: 1582 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAFGDAFNAYYA

SEQ ID NO: 1583 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAFGDQFNAYYA

SEQ ID NO: 1584 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDAFNAYYA

SEQ ID NO: 1585 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDQFNAYYA

SEQ ID NO: 1586 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALAAIGDAFNAYYA

SEQ ID NO: 1587 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGNAFNAYYA

SEQ ID NO: 1588 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAFNAYYA

SEQ ID NO: 1589 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDQFAAYYA

SEQ ID NO: 1590 - protein, 19 aa, Artificial Sequence
  Description of Artificial Sequence: Synthetic peptide
  N-term Ac
  MOD_RES (3)..(3): cyclohexyl-Ala
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWAAQALRAIGDAFNAYYA

SEQ ID NO: 1591 - protein, 19 aa, Artificial Sequence
  Description of Artificial Sequence: Synthetic peptide
  N-term Ac
  MOD_RES (3)..(3): hhLeu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWLAQALRAIGDAFNAYYA

SEQ ID NO: 1592 - protein, 19 aa, Artificial Sequence
  Description of Artificial Sequence: Synthetic peptide
  N-term Ac
  MOD_RES (3)..(3): Adamantyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWGAQALRAIGDAFNAYYA

SEQ ID NO: 1593 - protein, 19 aa, Artificial Sequence
  Description of Artificial Sequence: Synthetic peptide
  N-term Ac
  MOD_RES (3)..(3): homo-cyclohexyl-Ala
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWAAQALRAIGDAFNAYYA

SEQ ID NO: 1594 - protein, 19 aa, Artificial Sequence
  Description of Artificial Sequence: Synthetic peptide
  N-term Ac
  MOD_RES (3)..(3): homo-Phe
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDAFNAYYA

SEQ ID NO: 1595 - protein, 19 aa, Artificial Sequence
  Description of Artificial Sequence: Synthetic peptide
  N-term Ac
  MOD_RES (3)..(3): Indanyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWGAQALRAIGDAFNAYYA

SEQ ID NO: 1596 - protein, 19 aa, Artificial Sequence
  Description of Artificial Sequence: Synthetic peptide
  N-term Ac
  MOD_RES (3)..(3): Phe-4CF3
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDAFNAYYA

SEQ ID NO: 1597 - protein, 19 aa, Artificial Sequence
  Description of Artificial Sequence: Synthetic peptide
  N-term Ac
  MOD_RES (3)..(3): Phe-4tBu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWFAQALRAIGDAFNAYYA

SEQ ID NO: 1598 - protein, 19 aa, Artificial Sequence
  Description of Artificial Sequence: Synthetic peptide
  N-term Ac
  MOD_RES (3)..(3): 2-Naphthalanine
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWAAQALRAIGDAFNAYYA

SEQ ID NO: 1599 - protein, 19 aa, Artificial Sequence
  Description of Artificial Sequence: Synthetic peptide
  N-term Ac
  MOD_RES (3)..(3): Bip
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWXAQALRAIGDAFNAYYA

SEQ ID NO: 1600 - protein, 19 aa, Artificial Sequence
  Description of Artificial Sequence: Synthetic peptide
  N-term Ac
  MOD_RES (7)..(7): cyclohexyl-Ala
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAFNAYYA

SEQ ID NO: 1601 - protein, 19 aa, Artificial Sequence
  Description of Artificial Sequence: Synthetic peptide
  N-term Ac
  MOD_RES (7)..(7): hhLeu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1602 - protein, 19 aa, Artificial Sequence
  Description of Artificial Sequence: Synthetic peptide
  N-term Ac
  MOD_RES (7)..(7): Adamantyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAGRAIGDAFNAYYA

SEQ ID NO: 1603 - protein, 19 aa, Artificial Sequence
  Description of Artificial Sequence: Synthetic peptide
  N-term Ac
  MOD_RES (7)..(7): homo-cyclohexyl-Ala
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAFNAYYA

SEQ ID NO: 1604 - protein, 19 aa, Artificial Sequence
  Description of Artificial Sequence: Synthetic peptide
  N-term Ac
  MOD_RES (7)..(7): homo-Adamantyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAGRAIGDAFNAYYA

SEQ ID NO: 1605 - protein, 19 aa, Artificial Sequence
  Description of Artificial Sequence: Synthetic peptide
  N-term Ac
  MOD_RES (7)..(7): homo-Phe
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAFRAIGDAFNAYYA

SEQ ID NO: 1606 - protein, 19 aa, Artificial Sequence
  Description of Artificial Sequence: Synthetic peptide
  N-term Ac
  MOD_RES (7)..(7): Indanyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAGRAIGDAFNAYYA

SEQ ID NO: 1607 - protein, 19 aa, Artificial Sequence
  Description of Artificial Sequence: Synthetic peptide
  N-term Ac
  MOD_RES (7)..(7): Phe-4CF3
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAFRAIGDAFNAYYA

SEQ ID NO: 1608 - protein, 19 aa, Artificial Sequence
  Description of Artificial Sequence: Synthetic peptide
  N-term Ac
  MOD_RES (7)..(7): Phe-4tBu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAFRAIGDAFNAYYA

SEQ ID NO: 1609 - protein, 19 aa, Artificial Sequence
  Description of Artificial Sequence: Synthetic peptide
  N-term Ac
  MOD_RES (7)..(7): 2-Naphthalanine
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAARAIGDAFNAYYA

SEQ ID NO: 1610 - protein, 19 aa, Artificial Sequence
  Description of Artificial Sequence: Synthetic peptide
  N-term Ac
  MOD_RES (7)..(7): Bip
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAXRAIGDAFNAYYA

SEQ ID NO: 1611 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): Cyclobutyl-Ala
  MOD_RES (16)..(16): Alpha-Me S5-pentenyl-alanine olefin amino acid connected by an all-carbon crosslinker comprising one double bond
  C-term NH2
IWIAQALRAAGDAFNAYYA

SEQ ID NO: 1612 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): homo-Leu
  MOD_RES (16)..(16): Alpha-Me S5-pentenyl-alanine olefin amino acid connected by an all-carbon crosslinker comprising one double bond
  C-term NH2
IWIAQALRALGDAFNAYYA

SEQ ID NO: 1613 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): cyclohexyl-Ala
  MOD_RES (16)..(16): Alpha-Me S5-pentenyl-alanine olefin amino acid connected by an all-carbon crosslinker comprising one double bond
  C-term NH2
IWIAQALRAAGDAFNAYYA

SEQ ID NO: 1614 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): tert-Butyl-alanine
  MOD_RES (16)..(16): Alpha-Me S5-pentenyl-alanine olefin amino acid connected by an all-carbon crosslinker comprising one double bond
  C-term NH2
IWIAQALRAAGDAFNAYYA

SEQ ID NO: 1615 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): hhLeu
  MOD_RES (16)..(16): Alpha-Me S5-pentenyl-alanine olefin amino acid connected by an all-carbon crosslinker comprising one double bond
  C-term NH2
IWIAQALRALGDAFNAYYA

SEQ ID NO: 1616 - protein, 19 aa, Artificial Sequence
  Description of Artificial Sequence: Synthetic peptide
  N-term Ac
  MOD_RES (2)..(2): Alpha-Me-Trp
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1617 - protein, 19 aa, Artificial Sequence
  Description of Artificial Sequence: Synthetic peptide
  N-term Ac
  MOD_RES (2)..(2): 2-aminoisobutyric acid
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IXIAQALRAIGDAFNAYYA

SEQ ID NO: 1618 - protein, 19 aa, Artificial Sequence
  Description of Artificial Sequence: Synthetic peptide
  N-term Ac
  MOD_RES (1)..(1): Alpha-Me-Leu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
LWIAQALRAIGDAFNAYYA

SEQ ID NO: 1619 - protein, 19 aa, Artificial Sequence
  Description of Artificial Sequence: Synthetic peptide
  N-term Ac
  MOD_RES (3)..(3): Alpha-Me-Leu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWLAQALRAIGDAFNAYYA

SEQ ID NO: 1620 - protein, 19 aa, Artificial Sequence
  Description of Artificial Sequence: Synthetic peptide
  N-term Ac
  MOD_RES (4)..(4): 2-aminoisobutyric acid
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (12)..(12): Alpha-Me-Asp
  MOD_RES (16)..(16): Alpha-Me S5-pentenyl-alanine olefin amino acid connected by an all-carbon crosslinker comprising one double bond
  C-term NH2
IWIXQALRAIGDAFNAYYA

SEQ ID NO: 1621 - protein, 19 aa, Artificial Sequence
  Description of Artificial Sequence: Synthetic peptide
  N-term Ac
  MOD_RES (5)..(5): 2-aminoisobutyric acid
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAXALRAIGDAFNAYYA

SEQ ID NO: 1622 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (12)..(12): Alpha-Me-Asp
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1623 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (18)..(18): Phe-4F
  C-term NH2
IWIAQALRAIGDAFNAYFA

SEQ ID NO: 1624 - protein, 19 aa, Artificial Sequence
  Description of Artificial Sequence: Synthetic peptide
  N-term Ac
  MOD_RES (3)..(3): Tert-Butyl-alanine
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWAAQALRAIGDAFNAYYA

SEQ ID NO: 1625 - protein, 19 aa, Artificial Sequence
  Description of Artificial Sequence: Synthetic peptide
  N-term Ac
  MOD_RES (3)..(3): homo-Leu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWLAQALRAIGDAFNAYYA

SEQ ID NO: 1626 - protein, 19 aa, Artificial Sequence
  Description of Artificial Sequence: Synthetic peptide
  N-term Ac
  MOD_RES (3)..(3): Cyclohexyl-Gly
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWGAQALRAIGDAFNAYYA

SEQ ID NO: 1627 - protein, 19 aa, Artificial Sequence
  Description of Artificial Sequence: Synthetic peptide
  N-term Ac
  MOD_RES (3)..(3): Ac6c
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWXAQALRAIGDAFNAYYA

SEQ ID NO: 1628 - protein, 19 aa, Artificial Sequence
  Description of Artificial Sequence: Synthetic peptide
  N-term Ac
  MOD_RES (3)..(3): Ac5c
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWXAQALRAIGDAFNAYYA

SEQ ID NO: 1629 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
EWIAAALRAIGDAFNAYYA

SEQ ID NO: 1630 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
RWIAAALRAIGDAFNAYYA

SEQ ID NO: 1631 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
KWIAAALRAIGDAFNAYYA

SEQ ID NO: 1632 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
HWIAAALRAIGDAFNAYYA

SEQ ID NO: 1633 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
SWIAAALRAIGDAFNAYYA

SEQ ID NO: 1634 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
QWIAAALRAIGDAFNAYYA

SEQ ID NO: 1635 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
AWIAAALRAIGDAFNAYYA

SEQ ID NO: 1636 - protein, 19 aa, Artificial Sequence
  Description of Artificial Sequence: Synthetic peptide
  N-term Ac
  MOD_RES (1)..(1): 2-aminoisobutyric acid
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
XWIAAALRAIGDAFNAYYA

SEQ ID NO: 1637 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
FWIAAALRAIGDAFNAYYA

SEQ ID NO: 1638 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IDIAAALRAIGDAFNAYYA

SEQ ID NO: 1639 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IRIAAALRAIGDAFNAYYA

SEQ ID NO: 1640 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IHIAAALRAIGDAFNAYYA

SEQ ID NO: 1641 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
ISIAAALRAIGDAFNAYYA

SEQ ID NO: 1642 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
INIAAALRAIGDAFNAYYA

SEQ ID NO: 1643 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
ILIAAALRAIGDAFNAYYA

SEQ ID NO: 1644 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IFIAAALRAIGDAFNAYYA

SEQ ID NO: 1645 - protein, 19 aa, Artificial Sequence
  Description of Artificial Sequence: Synthetic peptide
  N-term Ac
  MOD_RES (2)..(2): 2-Naphthalanine
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IAIAAALRAIGDAFNAYYA

SEQ ID NO: 1646 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWISAALRAIGDAFNAYYA

SEQ ID NO: 1647 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWILAALRAIGDAFNAYYA

SEQ ID NO: 1648 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIFAALRAIGDAFNAYYA

SEQ ID NO: 1649 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIALALRAIGDAFNAYYA

SEQ ID NO: 1650 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALKAIGDAFNAYYA

SEQ ID NO: 1651 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (11)..(11): Abu
  MOD_RES (16)..(16): Alpha-Me S5-pentenyl-alanine olefin amino acid connected by an all-carbon crosslinker comprising one double bond
  C-term NH2
IWIAAALRAIXDAFNAYYA

SEQ ID NO: 1652 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIVDAFNAYYA

SEQ ID NO: 1653 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGEAFNAYYA

SEQ ID NO: 1654 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAGNAYYA

SEQ ID NO: 1655 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAWNAYYA

SEQ ID NO: 1656 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): homo-Phe
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1657 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): Phe-4CF3
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1658 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): Phe-4tBu
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1659 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): 2-Naphthalanine
  MOD_RES (16)..(16): Alpha-Me S5-pentenyl-alanine olefin amino acid connected by an all-carbon crosslinker comprising one double bond
  C-term NH2
IWIAQALRAIGDAANAYYA

SEQ ID NO: 1660 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (14)..(14): Bip
  MOD_RES (16)..(16): Alpha-Me S5-pentenyl-alanine olefin amino acid connected by an all-carbon crosslinker comprising one double bond
  C-term NH2
IWIAQALRAIGDAXNAYYA

SEQ ID NO: 1661 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFDAYYA

SEQ ID NO: 1662 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFEAYYA

SEQ ID NO: 1663 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFQAYYA

SEQ ID NO: 1664 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFSAYYA

SEQ ID NO: 1665 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFHAYYA

SEQ ID NO: 1666 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNALYA

SEQ ID NO: 1667 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYAA

SEQ ID NO: 1668 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYLA

SEQ ID NO: 1669 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (18)..(18): cyclohexyl-Ala
  C-term NH2
IWIAQALRAIGDAFNAYAA

SEQ ID NO: 1670 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (18)..(18): homo-Phe
  C-term NH2
IWIAQALRAIGDAFNAYFA

SEQ ID NO: 1671 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYWA

SEQ ID NO: 1672 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (18)..(18): 2-Naphthalanine
  C-term NH2
IWIAQALRAIGDAFNAYAA

SEQ ID NO: 1673 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYD

SEQ ID NO: 1674 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYE

SEQ ID NO: 1675 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYQ

SEQ ID NO: 1676 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYS

SEQ ID NO: 1677 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYH

SEQ ID NO: 1678 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYR

SEQ ID NO: 1679 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAAALRAIGDAFNAYYK

SEQ ID NO: 1680 - protein, 19 aa, Artificial Sequence
  Description of Artificial Sequence: Synthetic peptide
  N-term Ac
  MOD_RES (7)..(7): Alpha-Me-Leu
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1681 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (12)..(12): Alpha-Me-Asp
  MOD_RES (16)..(16): Alpha-Me S5-pentenyl-alanine olefin amino acid connected by an all-carbon crosslinker comprising one double bond
  C-term NH2
IWIAQALRAIGDAFNAYYA

SEQ ID NO: 1682 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (17)..(17): Phe-4F
  C-term NH2
IWIAQALRAIGDAFNAFYA

SEQ ID NO: 1683 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  MOD_RES (19)..(19): 2-aminoisobutyric acid
  C-term NH2
IWIAQALRAIGDAFNAYYX

SEQ ID NO: 1684 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQAAXAIGDAFNAYYA

SEQ ID NO: 1685 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGNAFNAYYA

SEQ ID NO: 1686 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDAANAYYA

SEQ ID NO: 1687 - protein, 19 aa, Artificial Sequence
  Description of Artificial Sequence: Synthetic peptide
  N-term Ac
  MOD_RES (8)..(8): Cit
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALXAIGDAVNAYYA

SEQ ID NO: 1688 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Alpha-Me S5-pentenyl-alanine olefin amino acid connected by an all-carbon crosslinker comprising one double bond
  C-term NH2
IWIAQALRAIGDAFNAAYA

SEQ ID NO: 1689 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): homo-Leu
  MOD_RES (16)..(16): Alpha-Me S5-pentenyl-alanine olefin amino acid connected by an all-carbon crosslinker comprising one double bond
  MOD_RES (17)..(17): Phe-4F
  C-term NH2
IWIAQALRALGDAFNAFYA

SEQ ID NO: 1690 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): homo-Leu
  MOD_RES (16)..(16): Alpha-Me S5-pentenyl-alanine olefin amino acid connected by an all-carbon crosslinker comprising one double bond
  MOD_RES (18)..(18): Phe-4F
  C-term NH2
IWIAQALRALGDAFNAYFA

SEQ ID NO: 1691 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): homo-Leu
  MOD_RES (16)..(16): Alpha-Me S5-pentenyl-alanine olefin amino acid connected by an all-carbon crosslinker comprising one double bond
  MOD_RES (17)..(17): Phe-4F
  MOD_RES (18)..(18): Phe-4F
  C-term NH2
IWIAQALRALGDAFNAFFA

SEQ ID NO: 1692 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): homo-Leu
  MOD_RES (16)..(16): Alpha-Me S5-pentenyl-alanine olefin amino acid connected by an all-carbon crosslinker comprising one double bond
  MOD_RES (18)..(18): Phe-4F
  C-term NH2
AWIAAALRALGDAFNAYFA

SEQ ID NO: 1693 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): homo-Leu
  MOD_RES (16)..(16): Alpha-Me S5-pentenyl-alanine olefin amino acid connected by an all-carbon crosslinker comprising one double bond
  MOD_RES (18)..(18): Phe-4F
  C-term NH2
AWIAAALRALGDAFNAAFA

SEQ ID NO: 1694 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (10)..(10): homo-Leu
  MOD_RES (16)..(16): Alpha-Me S5-pentenyl-alanine olefin amino acid connected by an all-carbon crosslinker comprising one double bond
  MOD_RES (17)..(17): Phe-4F
  MOD_RES (18)..(18): Phe-4F
  C-term NH2
IWIAQAARALGDAFNAFFA

SEQ ID NO: 1695 - protein, 19 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  MISC_FEATURE (2)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
IAIAQALRAIGDEFNAYYA

SEQ ID NO: 1696 - protein, 19 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  MISC_FEATURE (5)..(9): Crosslink between residues
  MOD_RES (9)..(9): Two pentenyl-alanine olefin side chains, each of which is crosslinked to another amino acid as indicated
  MISC_FEATURE (9)..(16): Crosslink between residues
  MOD_RES (16)..(16): Alpha-Me S8-octenyl-alanine olefin amino acid connected by an all-carbon crosslinker comprising one double bond
  C-term NH2
IWIAAALRAIGDEFNAYYA

SEQ ID NO: 1697 - protein, 21 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  MISC_FEATURE (9)..(16): Crosslink between residues
  MOD_RES (16)..(16): Two pentenyl-alanine olefin side chains, each of which is crosslinked to another amino acid as indicated
  MISC_FEATURE (16)..(20): Crosslink between residues
  MOD_RES (20)..(20): Alpha-Me R5-pentenyl-alanine olefin amino acid connected by an all-carbon crosslinker comprising one double bond
  C-term NH2
IWIAQALRAIGDEFNAYYAAA

What is claimed is:

1. An aqueous pharmaceutical formulation in a unit dosage form comprising:
 a peptidomimetic macrocycle or a pharmaceutically acceptable salt thereof, wherein the peptidomimetic macrocycle has an amino acid sequence identical to a sequence of any one of SEQ ID NOs: 339, 350, 351, 446, 447, 453, 457-459, 472-475, 478-481, 484, 485, 486, 492, 493, and 499, and wherein the peptidomimetic macrocycle is present in the aqueous pharmaceutical formulation in an amount of about 15-20 mg/mL;
 (ii) a buffering agent at a concentration of 20 mM, wherein the buffering agent is a sodium phosphate;
 (iii) a stabilizing agent in an amount of 300 ppm in the aqueous pharmaceutical formulation, wherein the stabilizing agent is polysorbate 20;
 (iv) a tonicity agent in a concentration of about 240 mM in the aqueous pharmaceutical formulation, wherein the tonicity agent is trehalose;
 wherein the peptidomimetic macrocycle has a Formula I:

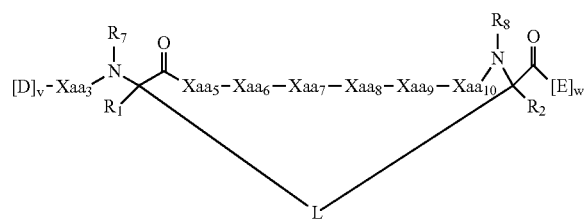

wherein
 each D, $Xaa_5$, $Xaa_6$, $Xaa_8$, $Xaa_9$, and E is independently an amino acid;
 each E is independently selected from Ala, D-Ala, Aib, Sar, and Ser;
 $[D]_v$ is $Leu_1$-$Thr_2$;
 $Xaa_3$ is Phe;
 $Xaa_7$ is Trp;
 $Xaa_{10}$ is Leu;
 each $R_1$ and $R_2$ is independently alkyl;
 L is a macrocycle-forming linker;
 $R_7$ is —H;
 $R_8$ is —H; and
 w is an integer from 1-10.

2. The aqueous pharmaceutical formulation of claim 1, wherein the peptidomimetic macrocycle has a length value of from 14 to 20 amino acids.

3. The aqueous pharmaceutical formulation of claim 1, wherein the peptidomimetic macrocycle has a von Heijne value of from 2 to 9.

4. The aqueous pharmaceutical formulation of claim 1, wherein the peptidomimetic macrocycle has a percent alanine content of from 15% to 40%.

5. The aqueous pharmaceutical formulation of claim 1, wherein a first, second, third, fourth, fifth, or sixth C-terminal amino acid of the peptidomimetic macrocycle is hydrophobic.

6. The aqueous pharmaceutical formulation of claim 1, wherein the peptidomimetic macrocycle comprises an α-helix.

7. The aqueous pharmaceutical formulation of claim 1, wherein the pharmaceutically acceptable salt of the peptidomimetic macrocycle is a sodium, potassium, lithium, calcium, zinc, or magnesium salt.

8. The aqueous pharmaceutical formulation of claim 1, wherein total peptidomimetic degradation products formed in the aqueous pharmaceutical formulation is less than 1.0% when stored at a temperature of 40° C. for a period of one month.

9. The aqueous pharmaceutical formulation of claim 1, wherein the aqueous pharmaceutical formulation upon storage for 24 months at from about 2° C. to about 8° C. comprises at least 95% of an amount of the peptidomimetic macrocycle present prior to the storage for 24 months.

10. The aqueous pharmaceutical formulation of claim 1, wherein an osmolarity of the aqueous pharmaceutical formulation is from about 250 to about 1000 milliosmoles per kilogram.

11. The aqueous pharmaceutical formulation of claim 1 further comprising glucose, fructose, galactose, sucrose, lactose, maltose, or a mixture thereof.

12. The aqueous pharmaceutical formulation of claim 1, wherein the tonicity agent is D-trehalose.

13. The aqueous pharmaceutical formulation of claim 1, wherein the aqueous pharmaceutical formulation has a pH from about 6.0 to about 8.0.

14. The aqueous pharmaceutical formulation of claim 1, wherein the aqueous pharmaceutical formulation has a pH from about 4.0 to about 9.0.

15. The aqueous pharmaceutical formulation of claim 1, wherein the peptidomimetic macrocycle has a molecular weight in the range of 1800-2000 D.

16. A method of making an aqueous pharmaceutical formulation comprising adding greater than 15 mg/mL of a peptidomimetic macrocycle or a pharmaceutically acceptable salt thereof to water or an aqueous solution, wherein the aqueous pharmaceutical formulation comprises less than 2% w/v of any micelle forming agent.

17. The method of claim 16, wherein the peptidomimetic macrocycle is capable of binding to the MDM2 and/or MDMX proteins.

18. The method of claim 16, comprising adding a sodium salt of the peptidomimetic macrocycle to water or an aqueous solution.

19. The method of claim 16, further comprising adjusting the pH of the solution comprising the buffering agent and the stabilizing agent during the addition of the peptidomimetic macrocycle.

20. The method of claim 16, further comprising filtration of the aqueous pharmaceutical formulation obtained after the addition of the peptidomimetic macrocycle to the aqueous solution.

21. The method of claim 16, wherein the method is used for commercial manufacturing of the aqueous pharmaceutical formulation.

22. The aqueous pharmaceutical formulation of claim 1, wherein the amino acid sequence is SEQ ID NO. 339.

23. The aqueous pharmaceutical formulation of claim 1, wherein the amino acid sequence is SEQ ID NO. 499.

24. The aqueous pharmaceutical formulation of claim 1, wherein the aqueous pharmaceutical formulation is suitable for administration to a subject without dilution.

* * * * *